(12) United States Patent
Samarsky

(10) Patent No.: US 12,378,552 B2
(45) Date of Patent: Aug. 5, 2025

(54) OLIGOMERIC COMPOUND FOR INHIBITING EXPRESSION OF FACTOR XI

(71) Applicant: Sirnaomics, Inc., Gatithersburg, MD (US)

(72) Inventor: Dmitry Samarsky, Gaithersburg, MD (US)

(73) Assignee: Sirnaomics, Inc., Germantown, MD (US)

( * ) Notice: Subject to any disclaimer, the term of this patent is extended or adjusted under 35 U.S.C. 154(b) by 37 days.

(21) Appl. No.: 17/720,129

(22) Filed: Apr. 13, 2022

(65) Prior Publication Data

US 2022/0364087 A1 Nov. 17, 2022

Related U.S. Application Data

(60) Provisional application No. 63/253,040, filed on Oct. 6, 2021, provisional application No. 63/174,533, filed on Apr. 13, 2021.

(51) Int. Cl.
  *C12N 15/113* (2010.01)
  *A61K 38/36* (2006.01)
  (Continued)

(52) U.S. Cl.
  CPC ............ *C12N 15/113* (2013.01); *A61K 38/36* (2013.01); *A61P 7/02* (2018.01); *C12N 9/6443* (2013.01);
  (Continued)

(58) Field of Classification Search
  CPC ................ C12N 15/113; C12N 9/6443; C12N 2310/11; A61K 38/36; A61P 7/02
  See application file for complete search history.

(56) References Cited

U.S. PATENT DOCUMENTS 8,334,372 B2 * 12/2012 Freier .................. A61K 31/366
                                                        536/24.1
2005/0187178 A1 * 8/2005 Allerson ................ C07H 21/02
                                                        536/23.1
(Continued)

FOREIGN PATENT DOCUMENTS

WO    WO-2022028457 A1 *  2/2022

OTHER PUBLICATIONS

Ge et al. Minimal-length short hairpin RNAs: The relationship of structure and RNAi activity, 2010, RNA, 16, 106-117. (Year: 2010).*

(Continued)

*Primary Examiner* — Jennifer Dunston
*Assistant Examiner* — Keyur A Vyas
(74) *Attorney, Agent, or Firm* — Edell, Shapiro & Finnan, LLC

(57) ABSTRACT

Products, compositions, and their uses are provided. In particular, nucleic acid products that modulate, in particular interfere with or inhibit, Factor XI (FXI) gene expression are provided. The products can be oligomeric compounds that comprise at least a first region of linked nucleosides having at least a first nucleobase sequence that is at least partially complementary to at least a portion of RNA transcribed from an FXI gene, wherein said first nucleobase sequence is selected from the following sequences, or a portion thereof: SEQ ID NOs 1 to 250.

20 Claims, 82 Drawing Sheets

Specification includes a Sequence Listing.

(51) Int. Cl.
*A61P 7/02* (2006.01)
*C12N 9/64* (2006.01)

(52) U.S. Cl.
CPC ... *C12N 2310/11* (2013.01); *C12Y 304/21027* (2013.01)

(56) References Cited

U.S. PATENT DOCUMENTS

| | | | |
|---|---|---|---|
| 2010/0137414 A1 | 6/2010 | Freier et al. | |
| 2015/0148530 A1* | 5/2015 | McSwiggen | C12N 15/1131 536/24.5 |
| 2021/0087569 A1 | 3/2021 | Bui | |

OTHER PUBLICATIONS

Hough et al., Why RNAi makes sense, 2003, Nature Biotech., 21, p. 731-732. (Year: 2003).*

Al-Horani et al., Factor XIa inhibitors: A review of the patent literature, 2016, Expert Opinion on Ther. Patents, 26, 323-345. (Year: 2016).*

Zhang, H., et al., "Inhibition of the intrinsic coagulation pathway factor XI by antisense oligunucleotides: a novel antithrombotic strategy with lowered bleeding risk", The American Society of Hematology, vol. 116, No. 22, 2010, pp. 4684-4692.

Buller, H., et al., "Factor XI Antisense Oligonucleotide for Prevention of Venous Thrombosis", New England Journal of Medicine, 372(3), 2015, 14 pages.

Yu, R., et al., "Lack of QT Prolongation for 2'-O-Methoxyethyl-Modified Antisense Oligonucleotides Based on Retrospective Exposure/Response Analysis of Ten Phase 1 Dose-Escalation Placebo-Controlled Studies in Healthy Subjects", Nucleic Acid Therapies, vol. 27, No. 5, 2017, pp. 285-294.

International Search Report and the Written Opinion in PCT/US2022/024672, Sep. 28, 2022, 14 pages.

* cited by examiner

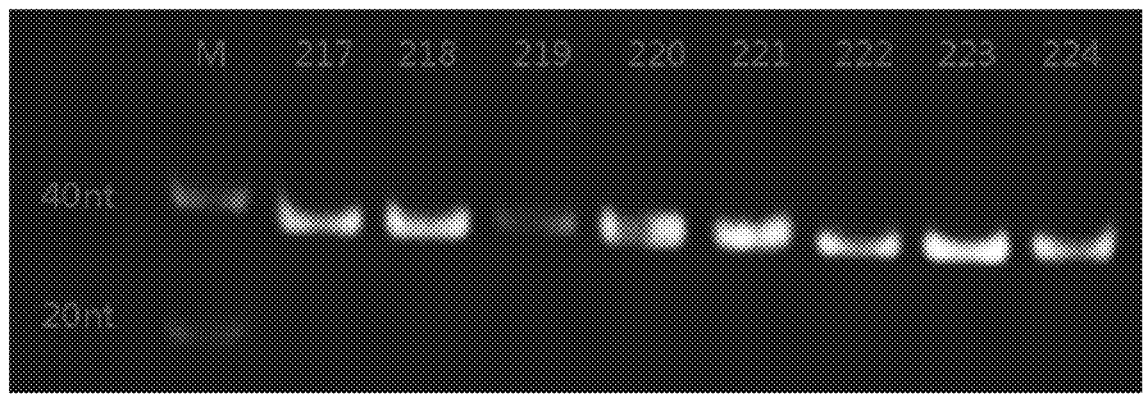
FIG. 1zii

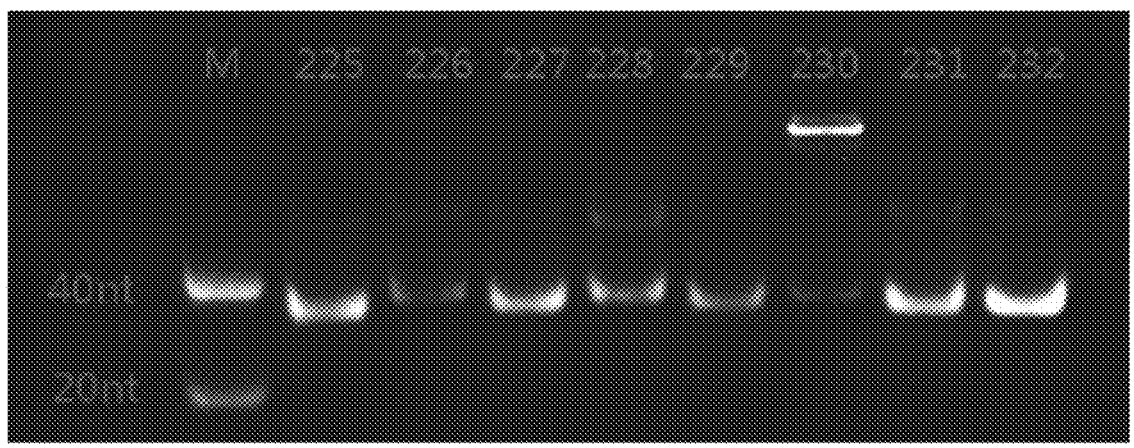
FIG. 1ziii

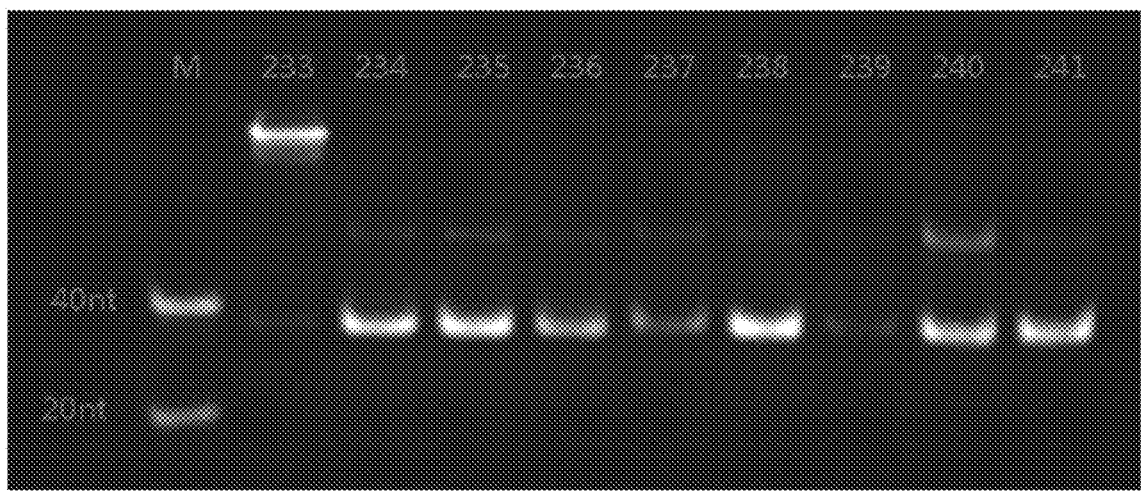
FIG. 1ziv

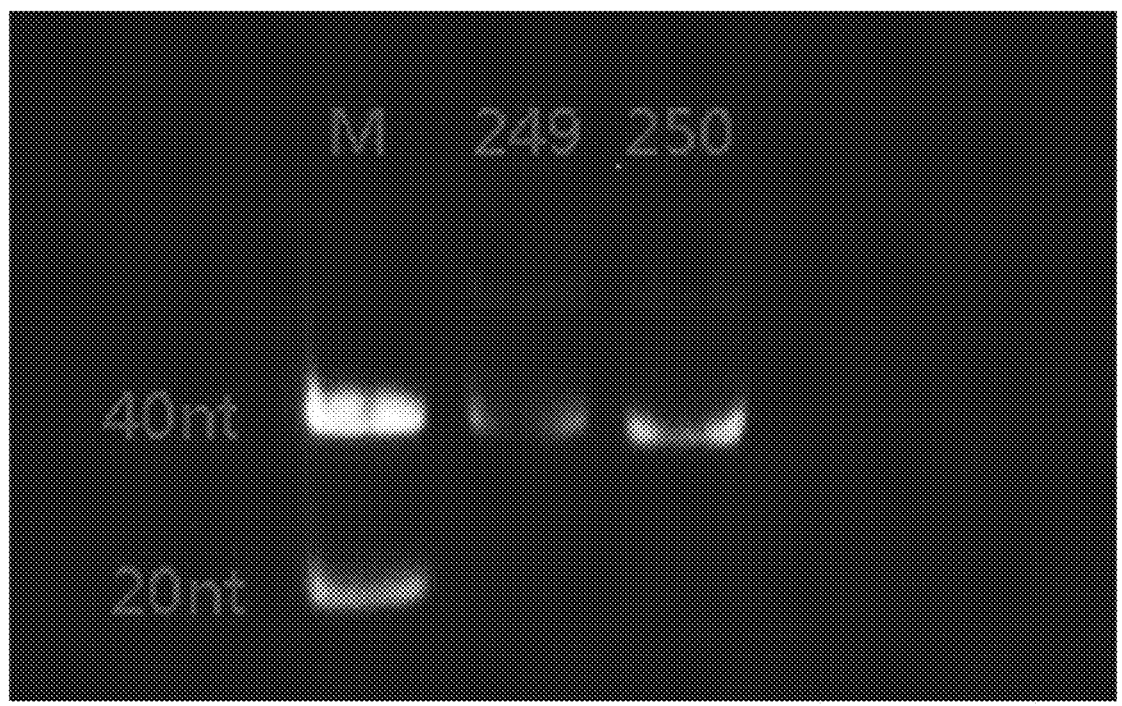
FIG. 1zvi

Sequence 91 H: Internal GalNAc & iR 3'-end stabilizer

| Position | 1 | 2 | 3 | 4 | 5 | 6 | 7 | 8 | 9 | 10 | 11 | 12 | 13 | 14 | 15 | 16 |
|---|---|---|---|---|---|---|---|---|---|---|---|---|---|---|---|---|
| | | | | | | | | | | | | | | | | C |
| 5' top | P U | U | A | U | A | A | G | A | A | A | A | C | A | U | C | |
| 5' bottom | A | A | U | A | U | C | U | U | U | U | A | G | U | A | | U |
| 3' | iN GN | | GN | | GN | | | GN | | | | | | | | G |

Legend:
- P: phosphate
- vP: vinyl-phosphonate
- v'P: bi-Me-vinyl-phosphonate
- 2'F
- 2'Me
- iN: inverted 2'OH
- (blank): phosphorothioate
- GN (conventional): Conventional 3xGalNAc
- N: 1xGalNAc at N's 2'OH
- GN (TEG): 3x toothbrush TEG GalNAc

| Construct ID | Primary Human Hepatocytes with Passive Uptake | |
|---|---|---|
| | %K/d at highest conc. (1000nM) | IC50 (nM) |
| 91A | 69 | 2.641 |
| 91B | 70 | 3.794 |
| 91C | 71 | 6.71 |
| 91E | -- | Not converged |
| 91F | 62 | 121 |
| 91I | 57 | 56.47 |
| 91J | 48 | 410.5 |
| 91K | 64 | 6.259 |
| 91L | 60 | 9.078 |
| 91M | 74 | 2.67 |
| 91N | 71 | 3.4 |
| 91O | 66 | 28.49 |
| 91 control | 55 | 164.5 |

FIG. 19a

| Name | Sequence |
|---|---|
| 91-TR-loop | /phos/ mU*fU*mC*fC*mC*fU/iN/iN/fAmU fGmAfUmUfUmUfCmUfUmAfU*mA*fA*/3galnac/ |
| 91-bmvp | /bmvps/ mU*fU*mC*fC*mC*fU*mC*fAmU fGmAfUmUfUmUfCmUfUmAfU*mA*fA*/3galnac/ |
| 91-conv (34-mer) | /phos/ mU*fU*mC*fC*mC*fU*mC*fAmU fGmAfUmUfUmUfCmUfUmAfU*mA*fA*/3galnac/ |
| 91-IR-3 | /phos/ mU*fU*mC*fC*mC*fU*mG*fAmU fGmAfUmUfUmUfCmUfUmAfU/iN/fA*/3galnac/ |
| 91-vp | /vp-mU/*fU*mC*fC*mC*fU*mC*fAmU fGmAfUmUfUmUfCmUfUmAfU*mA*fA*/3galnac/ |
| 91-conv (31-mer) | /phos/ mU*fC*mC*fU*mC* mU*fGmAfUmUfCmUfUmAfU*mA*fA*/3galnac/ |
| 91-conv (33-mer) | /phos/ mU*fC*mC*fU*mC* fA*mU*fC*mC* mU fGmAfUmUfCmUfUmAfU*mA*fA*/3galnac/ |

FIG. 20h

| Normalized to MAP4K4 | 16Dec2020 Study at Advirna (Primary human hepatocytes) | |
|---|---|---|
| | 3 Days | |
| Leads for Candidate | IC50 Values (nM) | % knockdown at highest conc. (1000 nM) |
| F11 - 91vP | 0.73 | 69 |
| F11 - 91-conv-34 | 6.17 | 70 |
| F11 - 91-conv-31 | 0.22 | 68 |
| F11 - 91A (conv-34) | 1.46 | 69 |
| F11-91B (vP) | 1.19 | 63 |
| F11-91L (matched 5') | 4.01 | 63 |
| F11 - 91-bmvp | 45.97 | 59 |

| Normalized to MAP4K4 | 07Jan2021 Study at Advirna (Primary human hepatocytes) | |
|---|---|---|
| | 3 Days | |
| Leads for Candidate | IC50 Values (nM) | % knockdown at highest conc. (1000 nM) |
| F11-91-bmvp | 76.49 | 58 |
| F11-91-IR Loop | 60.37 | 60 |
| F11-91-IR 3' End | 69.34 | 62 |
| F11-91-conv33 | 23.07 | 63 |

FIG. 21

| | Baseline (pre-treatment) | | | Week 2 (2 weeks post-treatment) | | | Week 6 | | |
|---|---|---|---|---|---|---|---|---|---|
| | Control | 10mg/kg | 3mg/kg (3x) | Control (Mean ±SD) | 10mg/kg (Mean ±SD) | 3mg/kg (3x) (Mean ±SD) | Control (Mean ±SD) | 10mg/kg (Mean ±SD) | 3mg/kg (3x) (Mean ±SD) |
| ALT (U/L) | 47 ± 11 | 50 ± 19 | 65 ± 17 | 34 ± 6 | 44 ± 16 | 60 ± 8 | 37 ± 13 | 42 ± 16 | 53 ± 15 |
| AST (U/L) | 47 ± 9 | 46 ± 6 | 68 ± 9 | 51 ± 12 | 48 ± 19 | 54 ± 10 | 40 ± 5 | 44 ± 3 | 54 ± 14 |
| ALP (U/L) | 496 ± 150 | 603 ± 119 | 475 ± 111 | 526 ± 135 | 588 ± 74 | 473 ± 100 | 584 ± 151 | 627 ± 151 | 487 ± 100 |
| TBIL (umol/L) | 3.6 ± 2.1 | 3.8 ± 1.3 | 4.2 ± 0.9 | 3.3 ± 0.4 | 3.6 ± 1 | 3.2 ± 1 | 3.3 ± 1.2 | 4.0 ± 1.6 | 3.8 ± 1.2 |
| Total Protein (g/L) | 74 ± 4 | 73 ± 4 | 76 ± 2 | 72 ± 2 | 72 ± 4 | 73 ± 3 | 76 ± 5 | 74 ± 1 | 75 ± 2 |
| Platelets (10x3/uL) | 399 ± 146 | 374 ± 93 | 430 ± 86 | 383 ± 113 | 381 ± 97 | 400 ± 58 | 363 ± 79 | 380 ± 69 | 462 ± 100 |
| RBCs (10x6/uL) | 5.6 ± 0.3 | 5.9 ± 0.3 | 5.7 ± 0.1 | 5.2 ± 0.4 | 5.5 ± 0.1 | 5.3 ± 0.4 | 5.4 ± 0.3 | 5.7 ± 0.3 | 5.3 ± 0.4 |
| WBC (10x3/uL) | 14.5 ± 3.8 | 11.9 ± 6.3 | 11.1 ± 4.3 | 13.3 ± 2.2 | 11.4 ± 3.3 | 10 ± 4.6 | 12.9 ± 1.9 | 11.3 ± 3.6 | 12.6 ± 4.6 |
| LDH | 702 ± 201 | 856 ± 438 | 1156 ± 462 | 1128 ± 466 | 805 ± 458 | 1285 ± 527 | 811 ± 172 | 817 ± 314 | 999 ± 242 |
| GLDH | 21 ± 5 | 29 ± 19 | 35 ± 2 | 23 ± 2 | 25 ± 14 | 28 ± 11 | 25 ± 5 | 24 ± 14 | 28 ± 10 |

FIG. 28

OLIGOMERIC COMPOUND FOR INHIBITING EXPRESSION OF FACTOR XI

This application claims priority to U.S. Provisional Application Ser. No. 63/250,040, filed Oct. 6, 2021, and 63/174,533, filed Apr. 13, 2021, the contents of each of which are hereby incorporated by reference in their entireties.

SEQUENCE LISTING

The instant application contains a Sequence Listing which has been submitted electronically in ASCII format and is hereby incorporated by reference in its entirety. Said ASCII copy, created on May 27, 2022, is named 4690_0046C_SL.txt and is 650.004 bytes in size.

FIELD

Nucleic acid products are provided that modulate, interfere with, or inhibit, Factor XI (FXI) gene expression. Methods, compounds, and compositions are provided for reducing expression of FXI mRNA and protein in an animal. Such methods, compounds, and compositions are useful to treat, prevent, or ameliorate thromboembolic diseases, such as deep vein thrombosis, venous or arterial thrombosis, pulmonary embolism, myocardial infarction, stroke, thrombosis associated with chronic kidney disease or end-stage renal disease (ESRD), including thrombosis associated with dialysis, or other procoagulant condition.

BACKGROUND

The circulatory system requires mechanisms that prevent blood loss, as well as those that counteract inappropriate intravascular obstructions. Generally, coagulation comprises a cascade of reactions culminating in the conversion of soluble fibrinogen to an insoluble fibrin gel. The steps of the cascade involve the conversion of an inactive zymogen to an activated enzyme. The active enzyme then catalyzes the next step in the cascade.

Coagulation Cascade

The coagulation cascade may be initiated through two branches, the tissue factor pathway (also "extrinsic pathway"), which is the primary pathway, and the contact activation pathway (also "intrinsic pathway").

The tissue factor pathway is initiated by the cell surface receptor tissue factor (TF, also referred to as Factor III), which is expressed constitutively by extravascular cells (pericytes, cardiomyocytes, smooth muscle cells, and keratinocytes) and expressed by vascular monocytes and endothelial cells upon induction by inflammatory cytokines or endotoxin. (Drake et al., Am J Pathol 1989, 134:1087-1097). TF is the high affinity cellular receptor for coagulation Factor VIIa, a serine protease. In the absence of TF, VIIa has very low catalytic activity, and binding to TF is necessary to render VIIa functional through an allosteric mechanism (Drake et al., Am J Pathol 1989, 134:1087-1097). The TF-VIIa complex activates Factor X to Xa. Xa in turn associates with its co-factor Factor Va into a prothrombinase complex which in turn activates prothrombin, (also known as Factor II or Factor 2) to thrombin (also known as Factor IIa, or Factor 2a).

Thrombin activates platelets, converts fibrinogen to fibrin and promotes fibrin cross-linking by activating Factor XIII, thus forming a stable plug at sites where TF is exposed on extravascular cells. In addition, thrombin reinforces the coagulation cascade response by activating Factors V and VIII. The contact activation pathway is triggered by activation of Factor XII to XIIa. Factor XIIa converts XI to XIa, and XIa converts IX to IXa. IXa associates with its cofactor Villa to convert X to Xa. The two pathways converge at this point as Factor Xa associates with Factor Va to activate prothrombin (Factor II) to thrombin (Factor 11a). Factor XI enhances both the formation and stability of clots in vitro, but is not thought to be involved in the initiation of clotting. Rather, Factor XI is important in the propagation phase of clot growth (von de Borne, et al., Blood Coagulation and Fibrinolysis, 2006, 17:251-257). Additionally, Factor XI-dependent amplification of thrombin formation leads to activation of TAFI (thrombin activatable fibrinolysis inhibitor), which renders clots less sensitive to fibrinolysis (Bouma et al, J Thromb Haemost 1999; 82:1703-1708).

Inhibition of Coagulation

At least three mechanisms keep the coagulation cascade in check, namely the action of activated protein C, antithrombin, and tissue factor pathway inhibitor. Activated protein C is a serine protease that degrades cofactors Va and Villa. Protein C is activated by thrombin with thrombomodulin, and requires coenzyme Protein S to function. Antithrombin is a serine protease inhibitor (serpin) that inhibits serine proteases: thrombin, Xa, XIIa, XIa and IXa. Tissue factor pathway inhibitor inhibits the action of Xa and the TF-VIIa complex. (Schwartz A L et al., Trends Cardiovasc Med. 1997; 7:234-239.)

Disease

Thrombosis is the pathological development of blood clots, and an embolism occurs when a blood clot migrates to another part of the body and interferes with organ function. Thromboembolism may cause conditions such as deep vein thrombosis, pulmonary embolism, myocardial infarction, and stroke. While most cases of thrombosis are due to acquired extrinsic problems, for example, surgery, cancer, immobility, some cases are due to a genetic predisposition, for example, antiphospholipid syndrome and the autosomal dominant condition, Factor V Leiden. (Bertina R M et al. Nature 1994; 369:64-67.)

Treatment

The most commonly used anticoagulants, warfarin, heparin, low molecular weight heparin (LMWH), and newer direct oral anticoagulants (DOAC), all possess significant drawbacks. Warfarin is typically used to treat patients suffering from atrial fibrillation. The drug interacts with vitamin K-dependent coagulation factors which include Factors II, VII, IX and X. Anticoagulant proteins C and S are also inhibited by warfarin. Drug therapy using warfarin is further complicated by the fact that warfarin interacts with other medications, including drugs used to treat atrial fibrillation, such as amiodarone. Because therapy with warfarin is difficult to predict, patients must be carefully monitored in order to detect any signs of anomalous bleeding.

Heparin functions by activating antithrombin which inhibits both thrombin and Factor X (Bjork I, Lindahl U. Mol Cell Biochem. 1982 48:161-182). Treatment with heparin may cause an immunological reaction that makes platelets aggregate within blood vessels that can lead to thrombosis. This side effect is known as heparin-induced thrombocytopenia (HIT) resulting in increased bleeding and requires patient monitoring. Prolonged treatment with heparin may also lead to osteoporosis. LMWH can also inhibit Factor II, but to a lesser degree than unfractioned heparin (UFH). LMWH has been implicated in the development of HIT.

Several direct oral anticoagulants have been FDA-approved for the treatment of thrombotic disease, including four Factor Xa inhibitors Betrixaban, Apixaban, Rivaroxaban and Edoxaban and one direct thrombin inhibitor Dabigatran. (Smith, M., Surg Clin N Am 2018 98:219-238). Rivaroxaban, Dabigatran and Edoxaban all exhibit increased bleeding, especially increased GI bleeding risk compared to warfarin.

There therefore remains a need for therapies to treat thromboembolic diseases without risk of increased bleeding. We, therefore, aim to provide compounds, methods, and pharmaceutical compositions for the treatment of such diseases.

Double-stranded RNA (dsRNA) able to complementarily bind expressed mRNA has been shown to be able to block gene expression (Fire et a.l, 1998, Nature. 1998 Feb. 19; 391 (6669): 806-1 1 and Elbashir et at., 2001, Nature. 2001 May 24; 41 1 (6836): 494-8) by a mechanism that has been termed RNA interference (RNAi). Short dsRNAs direct gene-specific, post-transcriptional silencing in many organisms, including vertebrates, and have become a useful tool for studying gene function. RNAi is mediated by the RNA-induced silencing complex (RISC), a sequence-specific, multi-component nuclease that destroys messenger RNAs homologous to the silencing trigger loaded into the RISC complex. Interfering RNA (iRNA) such as siRNAs, anti-sense RNA, and micro-RNA are oligonucleotides that prevent the formation of proteins by gene-silencing i.e. inhibiting gene translation of the protein through degradation of mRNA molecules. Gene-silencing agents are becoming increasingly important for therapeutic applications in medicine.

According to Watts and Corey in the Journal of Pathology (2012; Vol 226, p 365-379) there are algorithms that can be used to design nucleic acid silencing triggers, but all of these have severe limitations. It may take various experimental methods to identify potent siRNAs, as algorithms do not take into account factors such as tertiary structure of the target mRNA or the involvement of RNA binding proteins. Therefore the discovery of a potent nucleic acid silencing trigger with minimal off-target effects is a complex process. For the pharmaceutical development of these highly charged molecules it is necessary that they can be synthesised economically, distributed to target tissues, enter cells and function within acceptable limits of toxicity. An aim is to, therefore, provide compounds, methods, and pharmaceutical compositions for the treatment of thromboembolic diseases as described herein, which comprise oligomeric compounds that modulate and inhibit, gene expression by RNAi.

SUMMARY

Nucleic acid products are provided that modulate, interfere with, or inhibit, Factor XI (FXI) gene expression, and associated therapeutic uses. Specific oligomeric compounds and sequences are described herein. This summary is not intended to identify key features or essential features of the subject matter as described herein, nor is it intended to be used to determine the scope of that subject matter.

Detailed Description and Embodiments

The embodiments described below are exemplary but the skilled artisan will recognize that additional embodiments may be achieved.

It will be understood that the benefits and advantages described herein may relate to one embodiment or may relate to several embodiments. The embodiments are not limited to those that solve any or all of the stated problems or those that have any or all of the stated benefits and advantages.

Features of different aspects and embodiments may be combined as appropriate, as would be apparent to a skilled person, and may be combined with any of the aspects as described herein.

BRIEF DESCRIPTION OF THE DRAWINGS

The embodiments described below are by way of example only and with reference to the following non-limiting drawings, in which:

FIG. 1a illustrates the stability of duplexes 1 to 8.
FIG. 1l illustrates the stability of duplexes 89 to 96.
FIG. 1z illustrates the stability of duplexes 201 to 208.
FIG. 1zi illustrates the stability of duplexes 209 to 216.
FIG. 1zii illustrates the stability of duplexes 217 to 224.
FIG. 1ziii illustrates the stability of duplexes 225 to 232.
FIG. 1ziv illustrates the stability of duplexes 233 to 241.
FIG. 1zv illustrates the stability of duplexes 242 to 248.
FIG. 1zvi illustrates the stability of duplexes 249 and 250.

Figures 15, 16, 17:
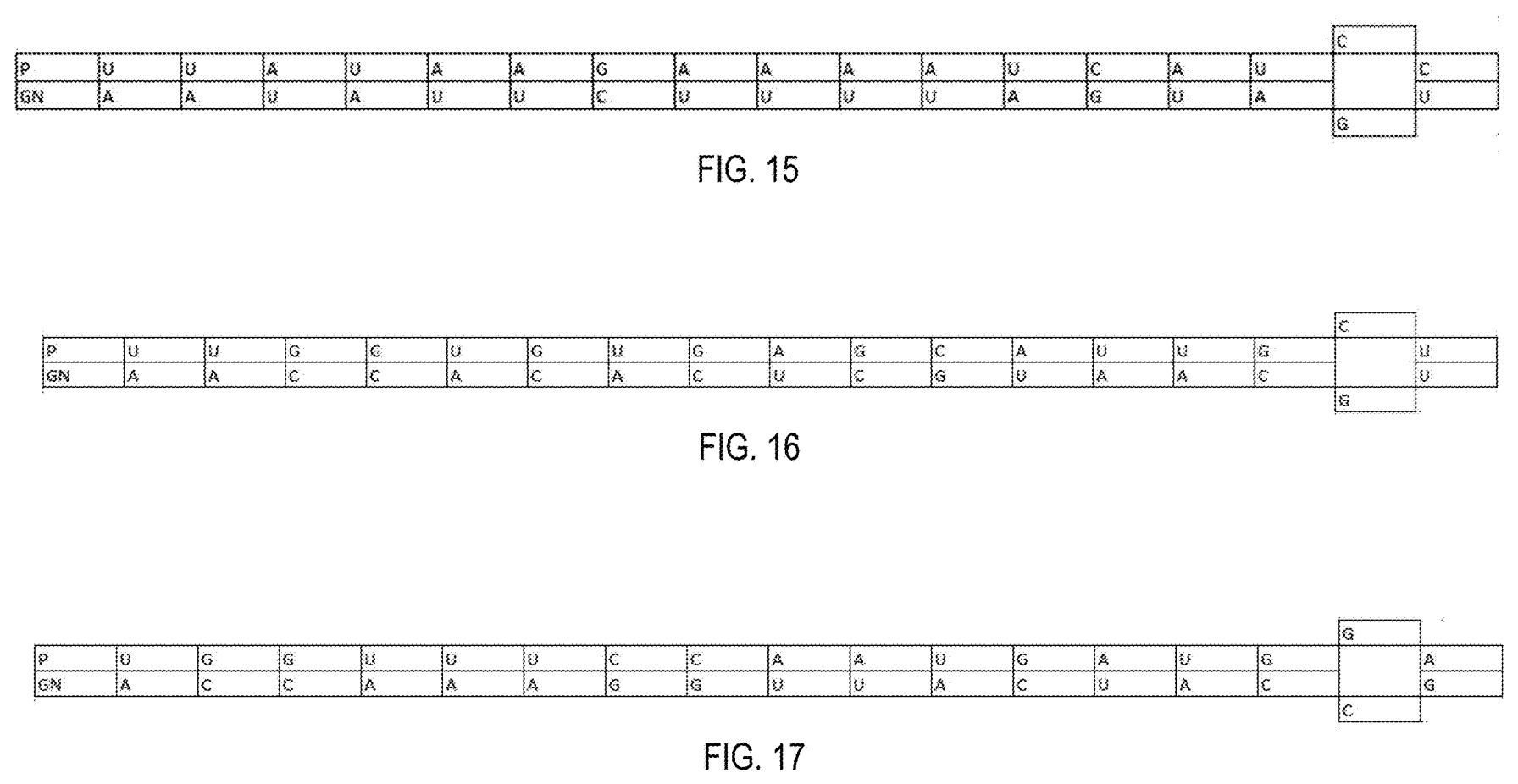

FIG. 15 to 17 shows the sequence of an oligomeric compound F11-91 (SEQ ID NO. 2252) that is a combination of two sequences: SEQ ID NO: 91 and 341.

FIG. 16 shows the sequence of an oligomeric compound F11-46 (SEQ ID NO: 2251) that is a combination of two sequences: SEQ ID NOs: 46 and 296.

FIG. 17 shows the sequence of an oligomeric compound F11-152 (SEQ ID NO: 2253) that is a combination of two sequences: SEQ ID NOs: 152 and 402.

Figure 18A:
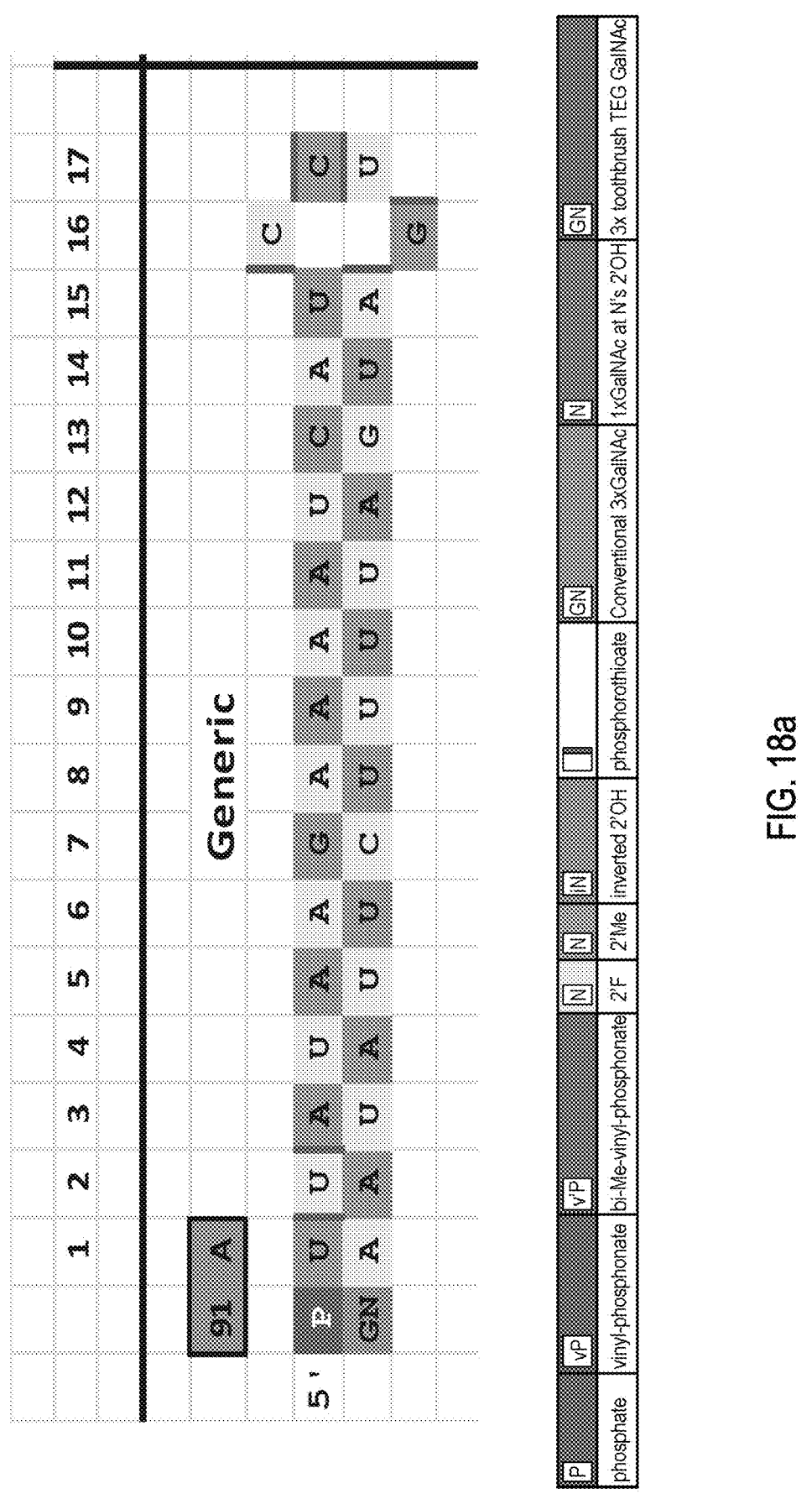
Figure 18D:
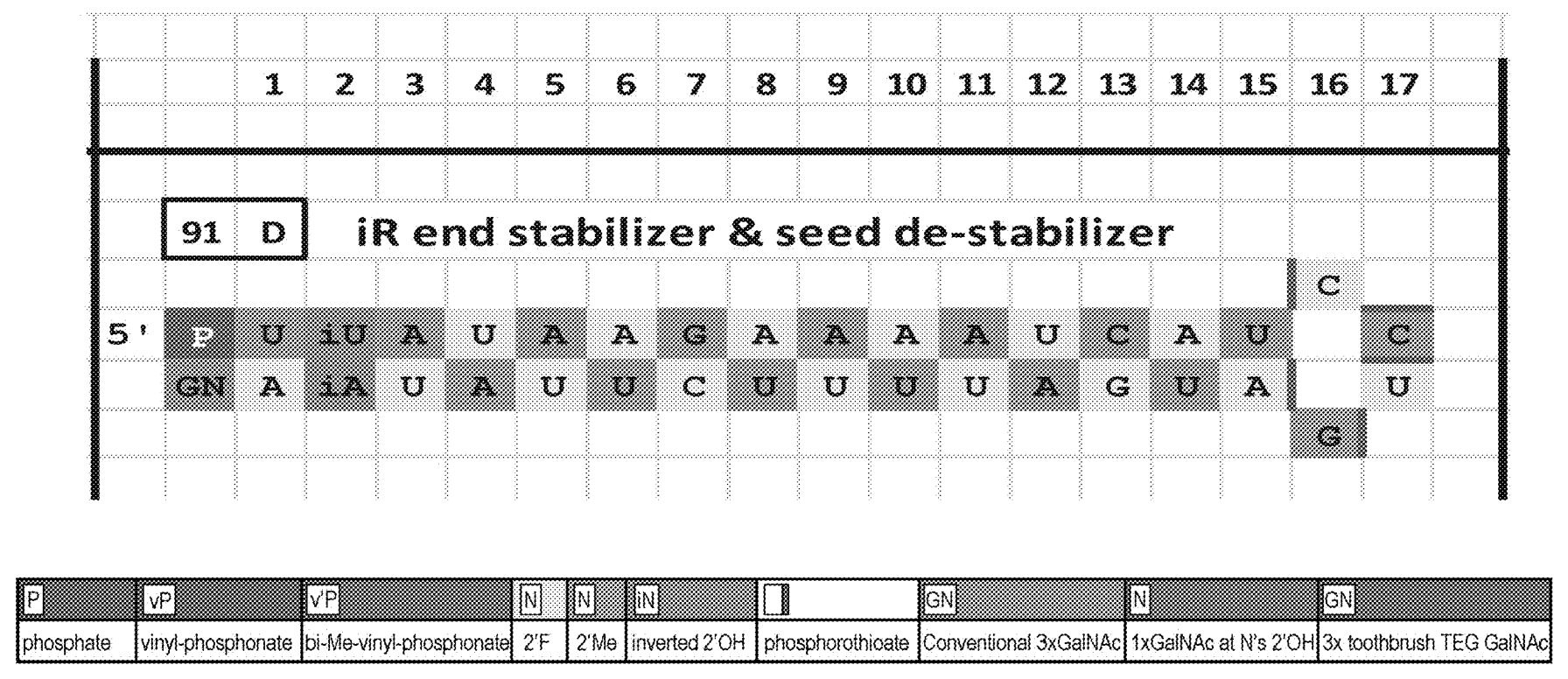
Figure 18K:
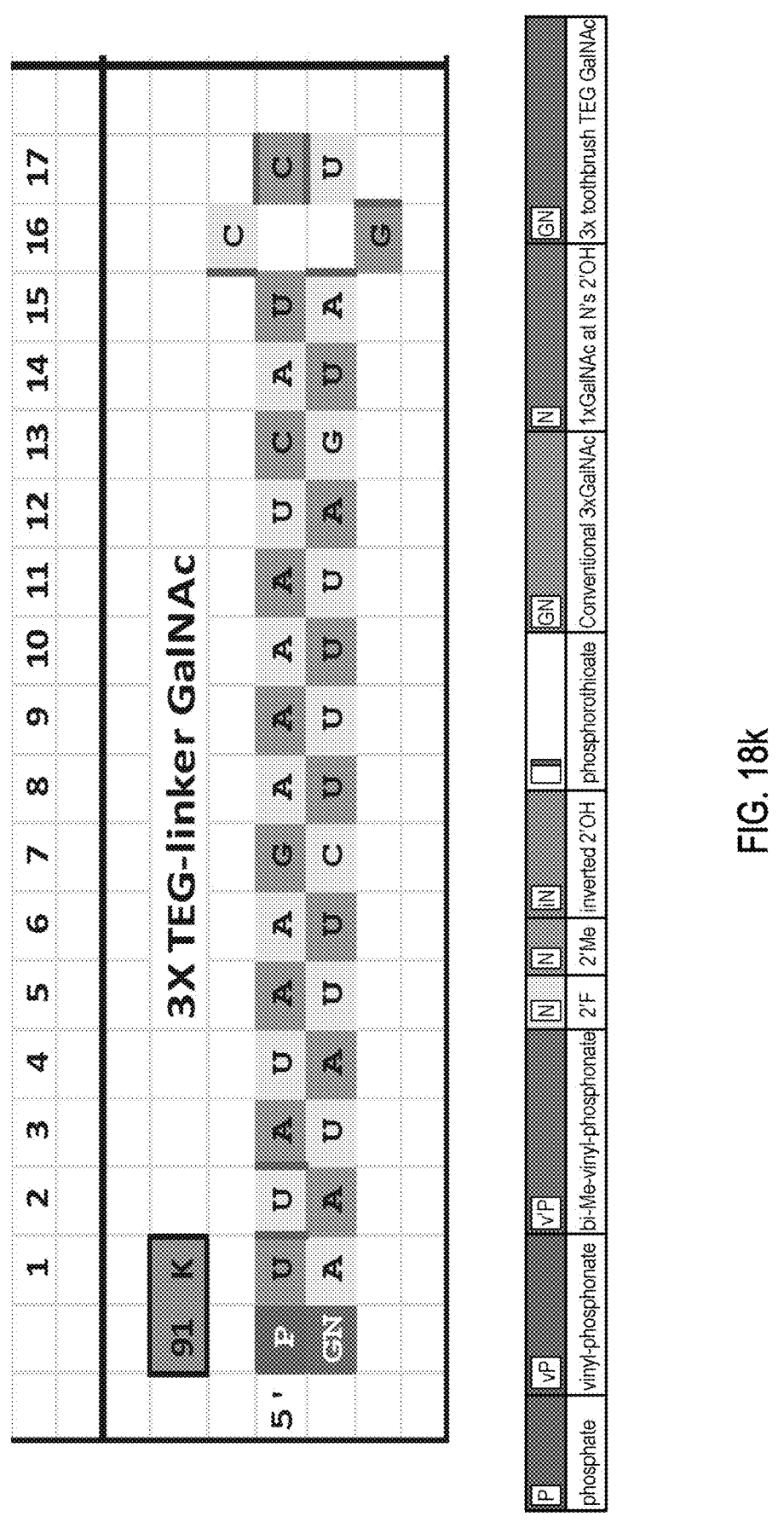
Figure 18M:
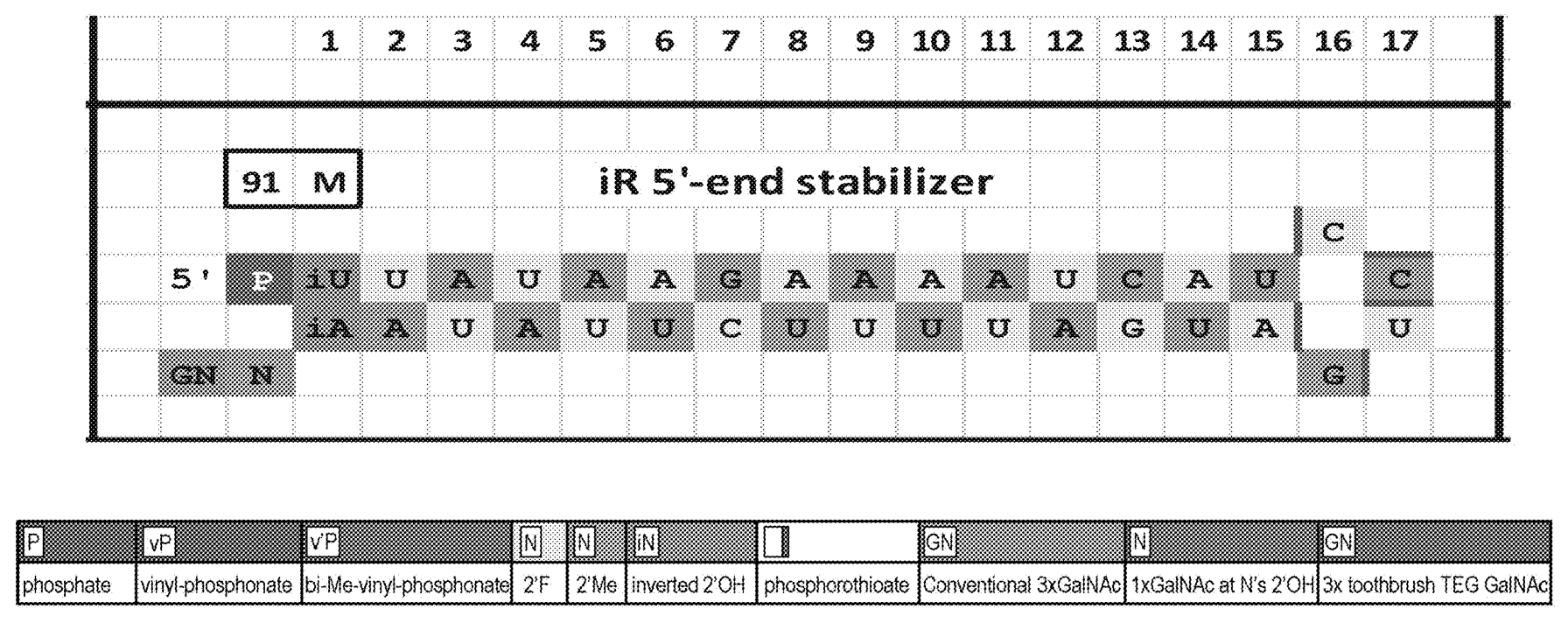
Figure 18N:
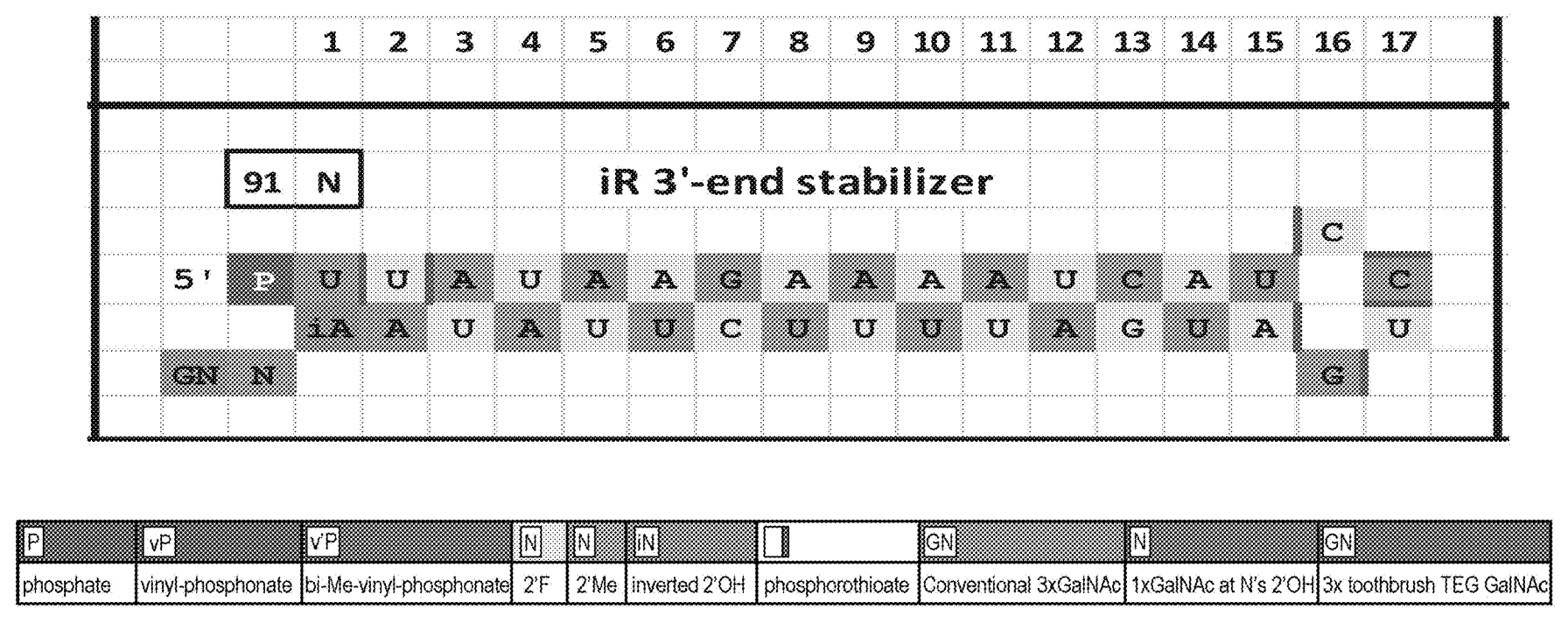
Figure 18O:
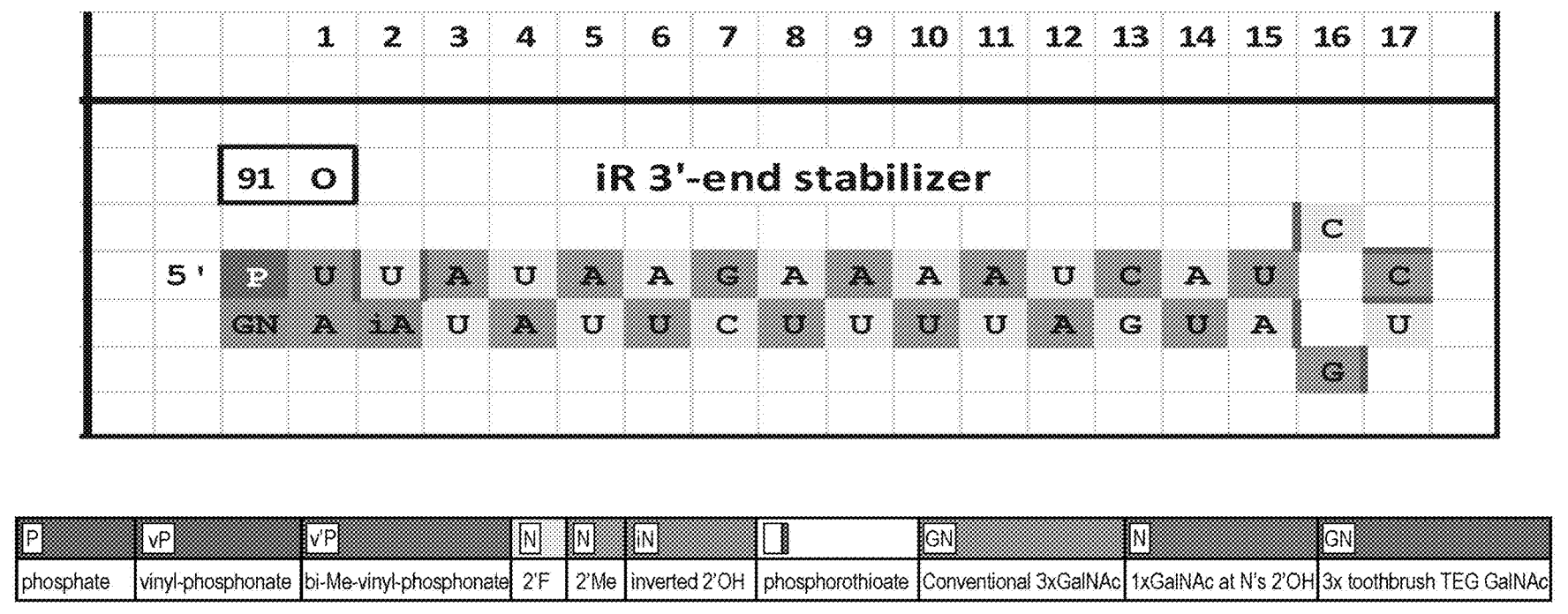

FIGS. 18a-18p illustrate compounds selected for medicinal chemistry; see SEQ ID NOS 2357, 2332-2335, 2358, 2336-2339, 2359, and 2340-2345, respectively, in order of appearance.

FIG. 18a illustrates a generic duplex (91A, See also SEQ ID No. 2252).

FIG. 18d illustrates a duplex containing an iR end stabilizer and seed de-stabilizer. (91D, See also SEQ ID No. 2252).

FIG. 18h illustrates a duplex containing internal GalNAc and iR 3'-end stabilizer. (91H, See also SEQ ID No. 2252).

FIG. 18k illustrates a duplex containing 3X TEG-linker GalNAc. (91 K, See also SEQ ID No. 2252).

FIG. 18l illustrates a generic duplex with matching 5' nucleotide. (91 L, See also, SEQ ID No. 2252).

FIG. 18m illustrates a duplex containing iR 5'-end stabilizer. (91 M, See also SEQ ID No. 2252).

FIG. 18n illustrates a duplex containing iR 3'-end stabilizer. (91 N, See also SEQ ID No. 2252).

FIG. 18O illustrates a duplex containing iR 3'-end stabilizer. (91 O, See also SEQ ID No. 2252).

FIG. 18p illustrates a duplex with canonical control. (91Ctr, See also SEQ ID No. 2252).

FIGS. 19a-19c illustrate the performance of compounds shown in FIGS. 18a-18p:

FIG. 19a is a table showing percent k/d at the highest concentration and $IC_{50}$ values for 91A to 91O and 91Control constructs of FIGS. 18a-18p.

FIG. 19b illustrates gene expression as a percent of NT for a variety of constructs (91A-91F, 91I).

FIG. 19c illustrates gene expression as a percent of NT for a variety of constructs (91J-91O).

FIGS. 20a-20h depict several constructs, SEQ ID NOS 2346, 2360-2361, 2347, 2362, and 2348-2356, respectively, in order of appearance.

FIG. 20a illustrates a duplex containing an iR loop stabilizer.

FIG. 20b illustrates a duplex containing 5' bi-methyl vinyl-phosphonate

FIG. 20c illustrates a conventional duplex (34mer). See also SEQ ID Nos. 2292 and 2288 (Table 7).

FIG. 20d illustrates a duplex containing an iR 3'-end stabilizer.

FIG. 20e illustrates a duplex containing vinyl-phosphonate. See also SEQ ID Nos. 2291 and 2288 (Table 7).

FIG. 20f illustrates a conventional duplex (31mer). See also SEQ ID Nos. 2292 and 2287 (Table 7)

FIG. 20g illustrates a conventional duplex (33mer).

FIG. 20h provides the sequences of seven constructs (FIGS. 20a-20g above).

FIG. 21 shows data for the compounds displayed in FIG. 20.

FIG. 27a shows the time (sec) for activated partial thromboplastin (APTT) based on concentrations between 1 and 10 mg/kg.

FIG. 27b shows the time (sec) for prothrombin (PT) based on concentrations between 1 and 10 mg/kg.

FIG. 28 presents data demonstrating a lack of side effects.

DEFINITIONS

Figure 1A:
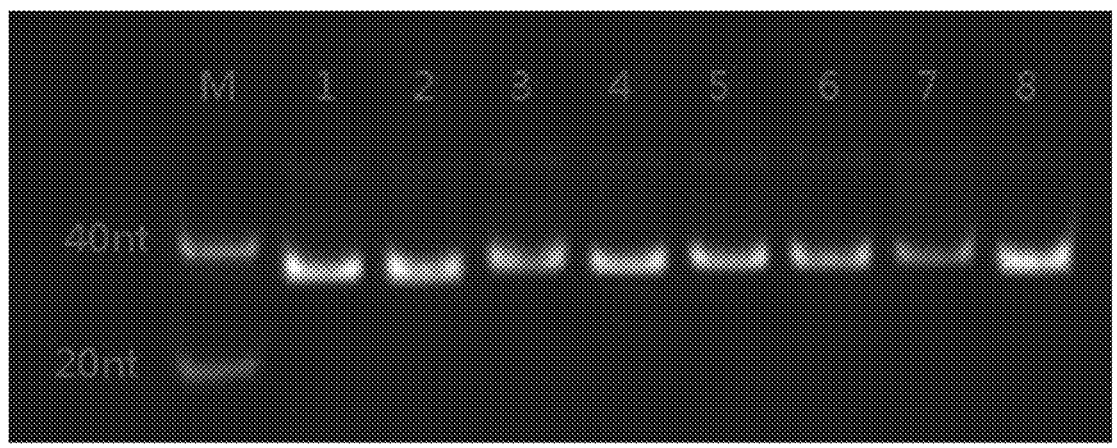
FIGS. 1a-1zvi illustrate the stability of 250 duplexes: Table 1a displays the nucleobase sequences of 250 antisense sequences (SEQ ID NOs: 1 to 250) and of 250 corresponding sense sequences (SEQ ID NOs: 251 to 500). Table 1b displays the corresponding modified constructs (constructs 501 to 750 being the modified counterparts of SEQ ID NOs: 1 to 250; and constructs 751 to 1000 being the modified counterparts of SEQ ID NOS: 251 to 500). Owing to complementarity, construct 501 base pairs with construct 751, construct 502 base pairs with construct 752 and so forth, giving rise to duplexes (double-stranded molecules). These duplexes are numbered according to the SEQ ID NO of the antisense nucleobase sequence they comprise, e.g. the duplex formed from constructs 501 and 751 is referred to as duplex 1, the duplex formed from constructs 502 and 752 is referred to duplex 2, and so forth. Based on this numbering scheme, the parts of FIG. 1 illustrate the following.
Figure 1B:
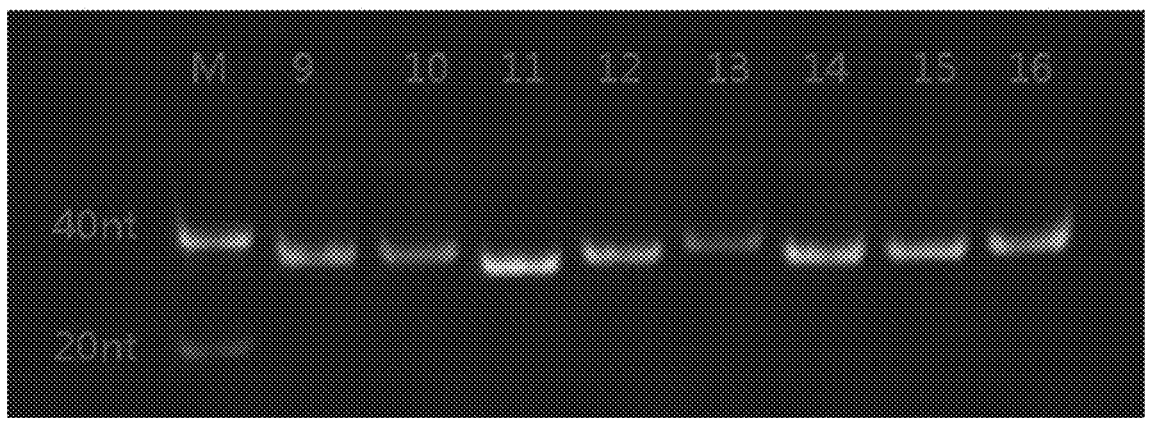
FIG. 1b illustrates the stability of duplexes 9 to 16.
Figure 1C:
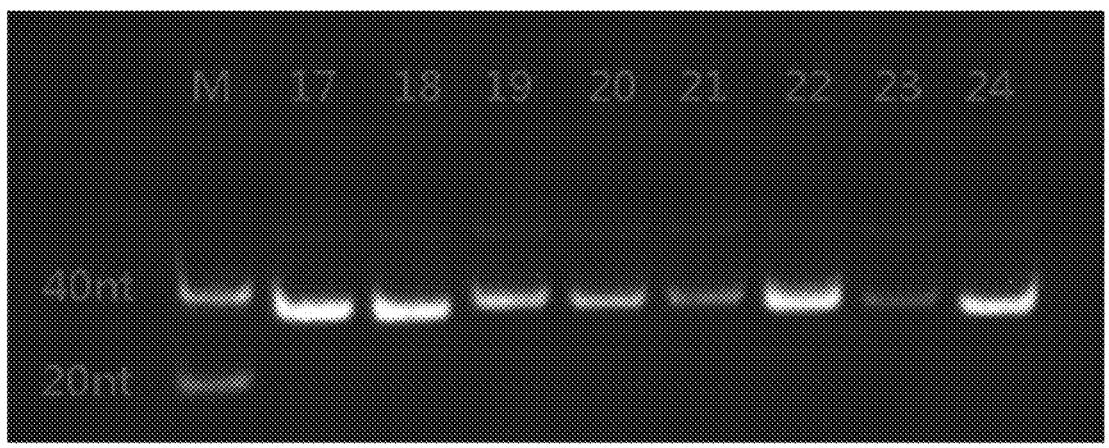
FIG. 1c illustrates the stability of duplexes 17 to 24.
Figure 1D:
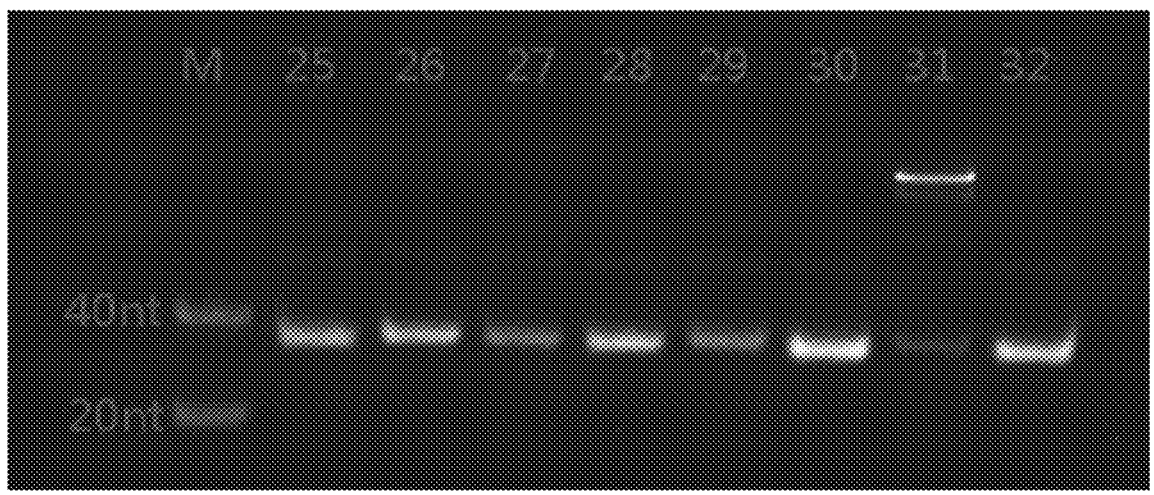
FIG. 1d illustrates the stability of duplexes 25 to 32.
Figure 1E:
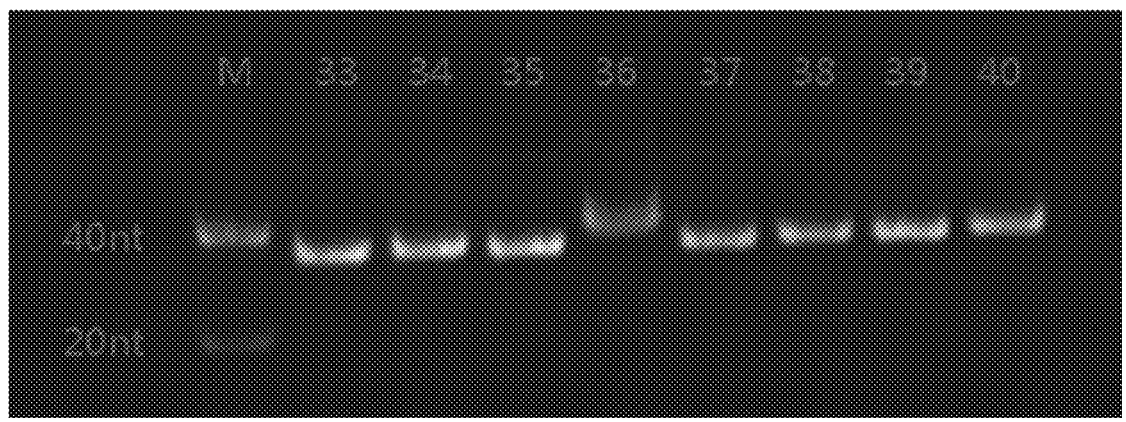
FIG. 1e illustrates the stability of duplexes 33 to 40.
Figure 1F:
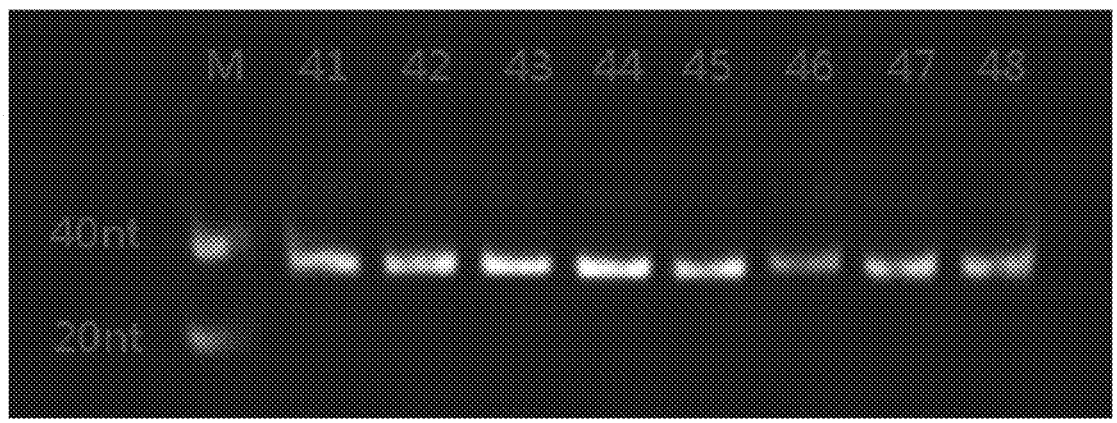
FIG. 1f illustrates the stability of duplexes 41 to 48.
Figure 1G:
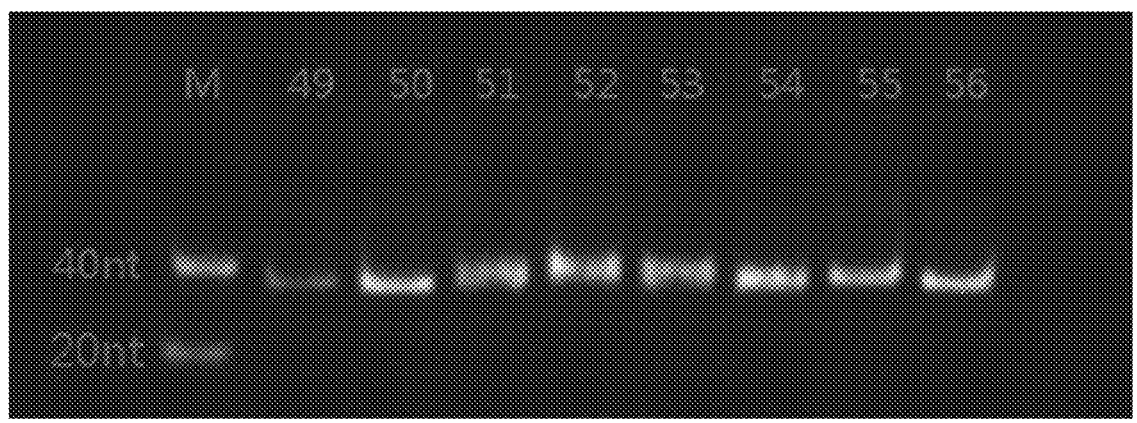
FIG. 1g illustrates the stability of duplexes 49 to 56.
Figure 1H:
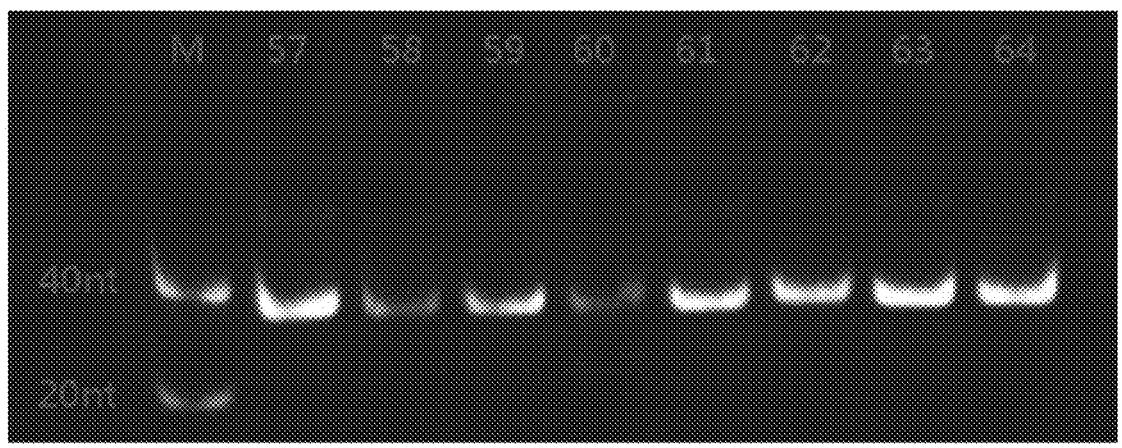
FIG. 1h illustrates the stability of duplexes 57 to 64.
Figure 1I:
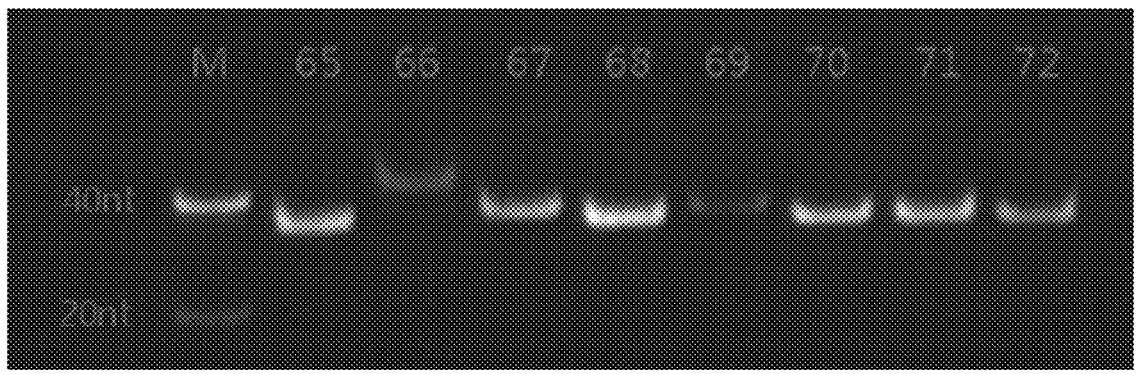
FIG. 1i illustrates the stability of duplexes 65 70 72.
Figure 1J:
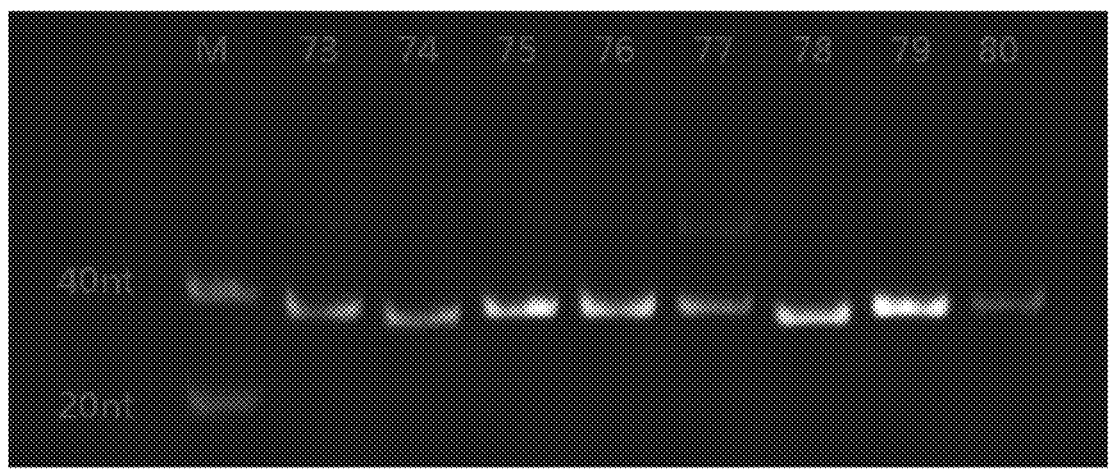
FIG. 1j illustrates the stability of duplexes 73 to 80.
Figure 1K:
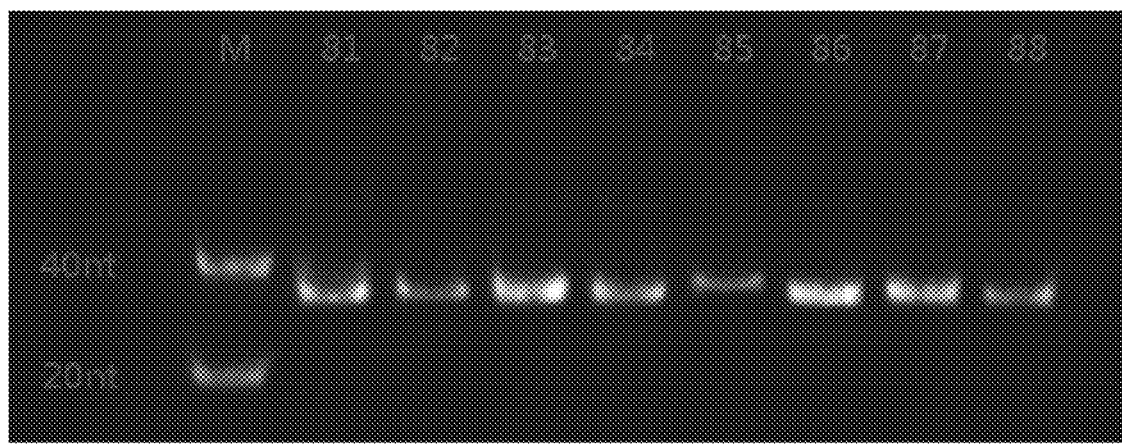
FIG. 1k illustrates the stability of duplexes 81 to 88.
Figure 1I:
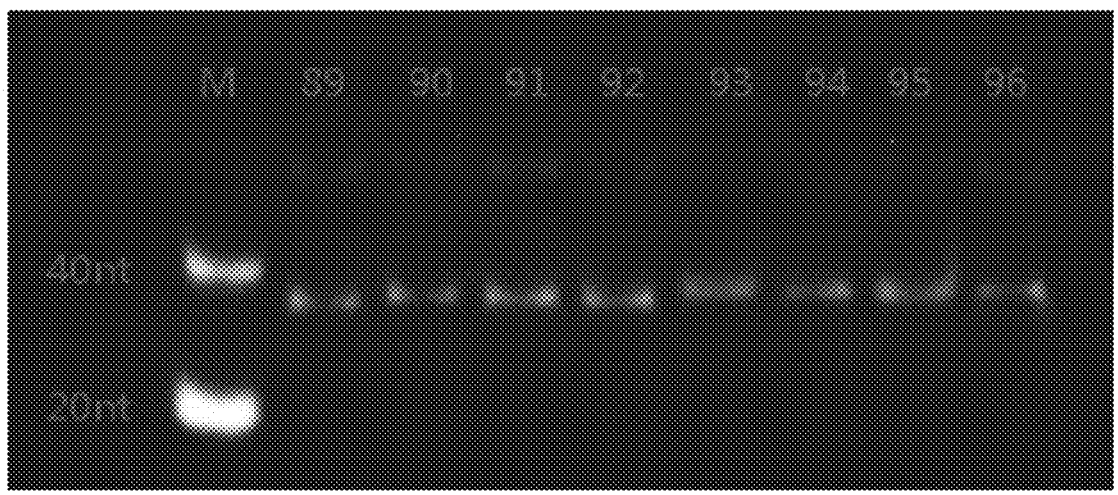
Figure 1M:
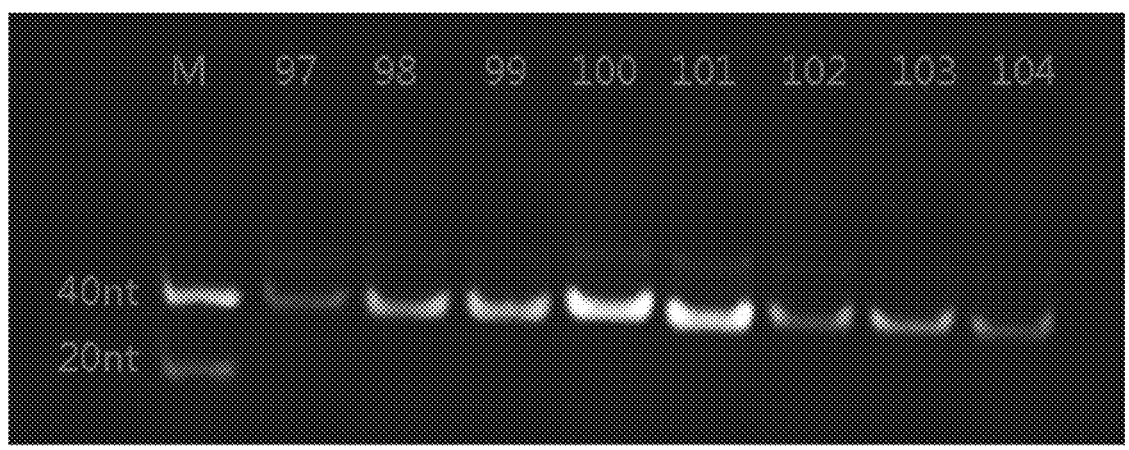
FIG. 1m illustrates the stability of duplexes 97 to 104.
Figure 1N:
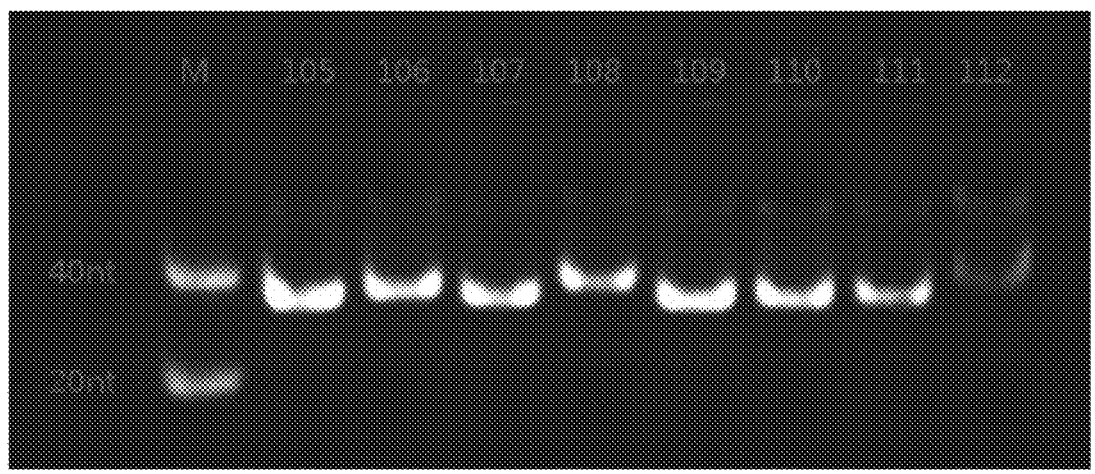
FIG. 1n illustrates the stability of duplexes 105 to 112.
Figure 1O:
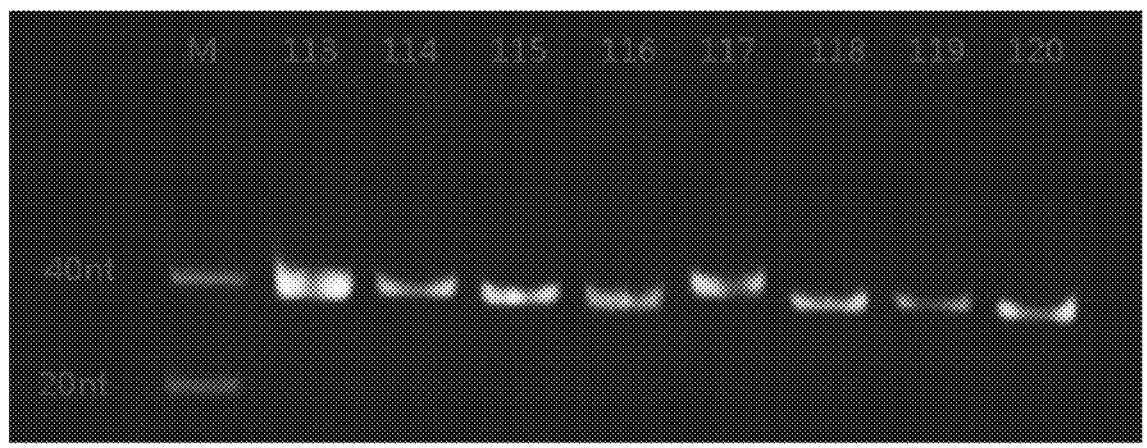
FIG. 1o illustrates the stability of duplexes 113 to 120.
Figure 1P:
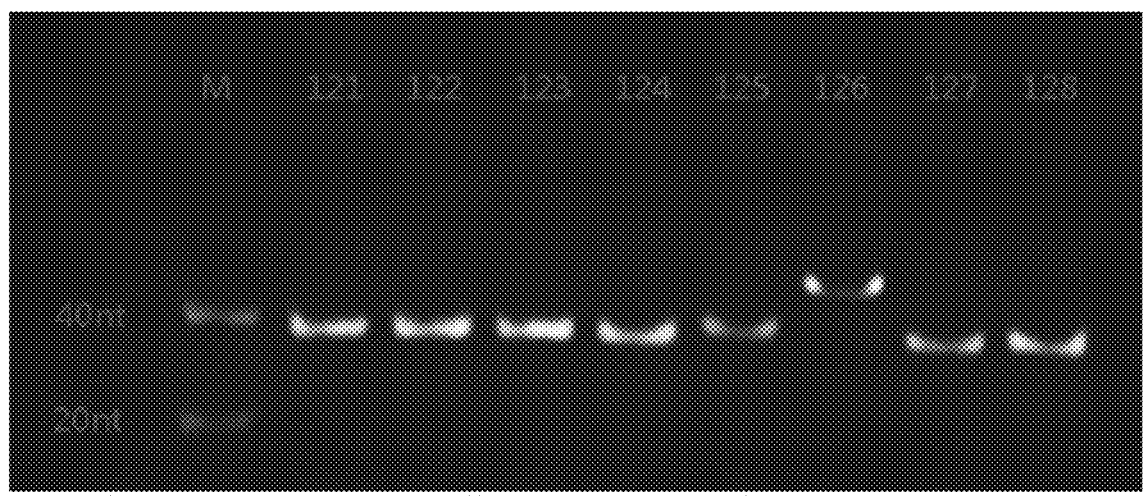
FIG. 1p illustrates the stability of duplexes 121 to 128.
Figure 1Q:
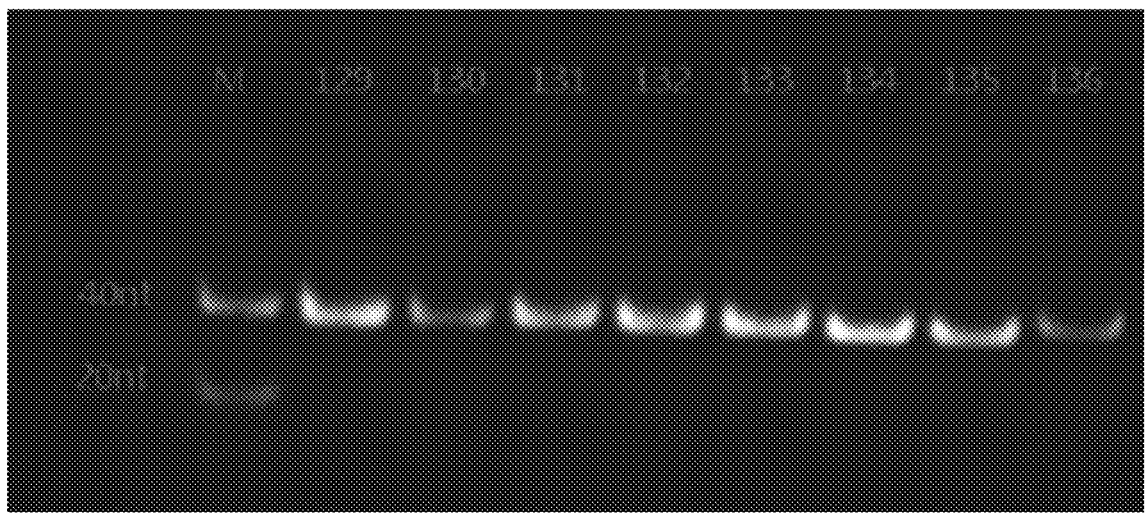
FIG. 1q illustrates the stability of duplexes 129 to 136.
Figure 1R:
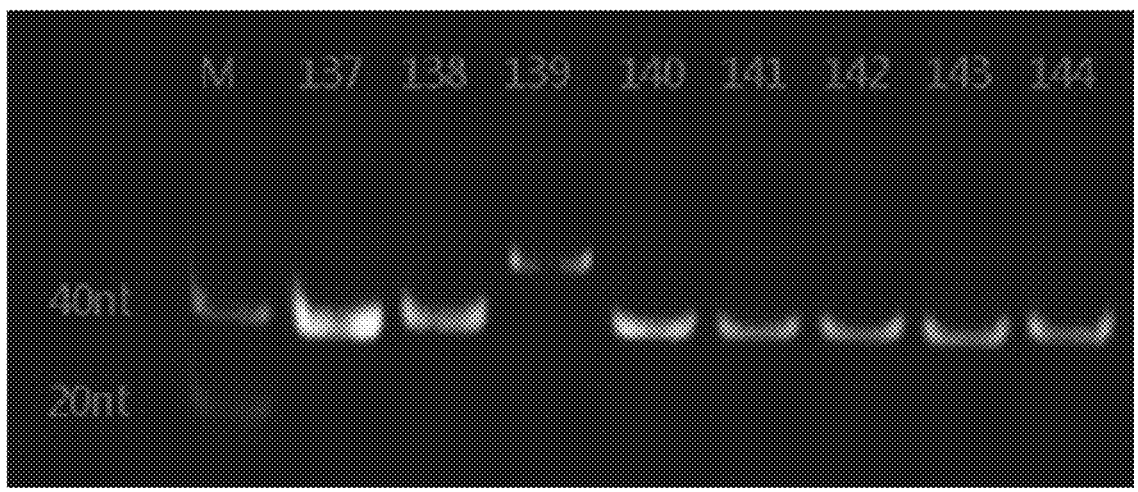
FIG. 1r illustrates the stability of duplexes 137 to 144.
Figure 1S:
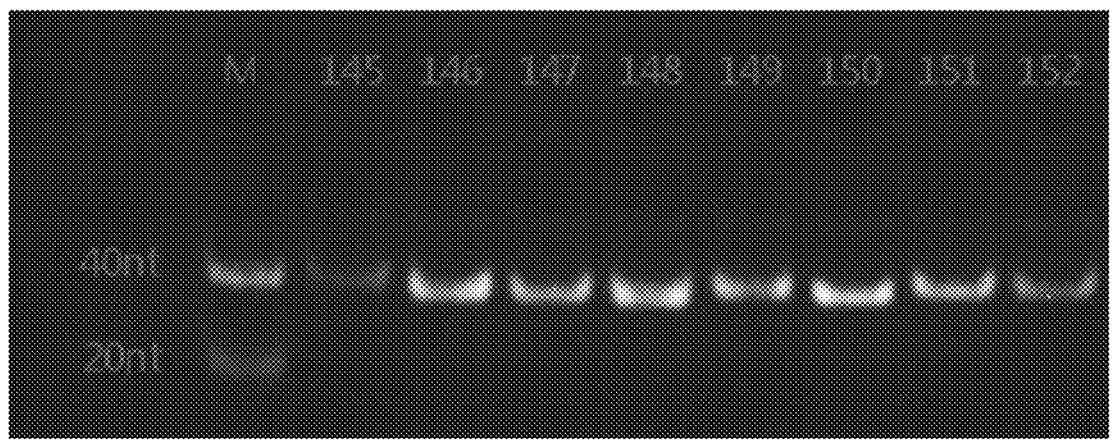
FIG. 1s illustrates the stability of duplexes 145 to 152.
Figure 1T:
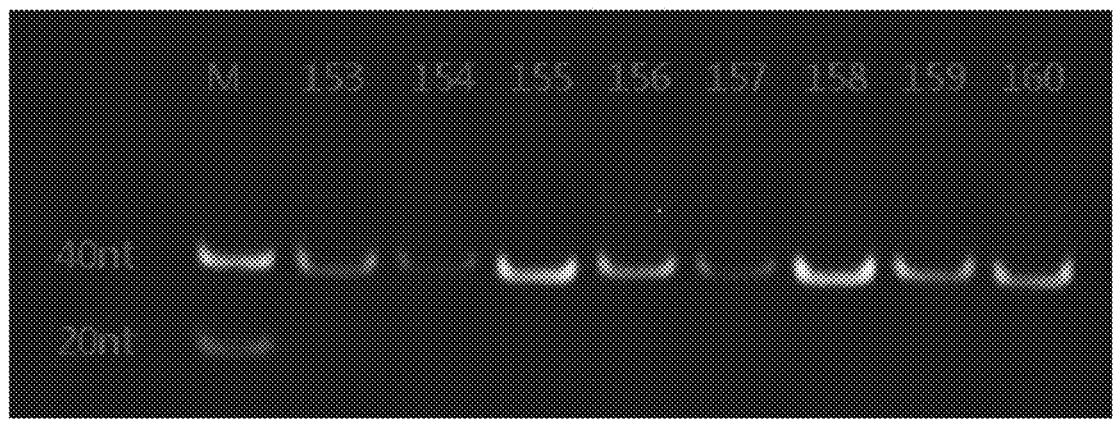
FIG. 1t illustrates the stability of duplexes 153 to 160.
Figure 1U:
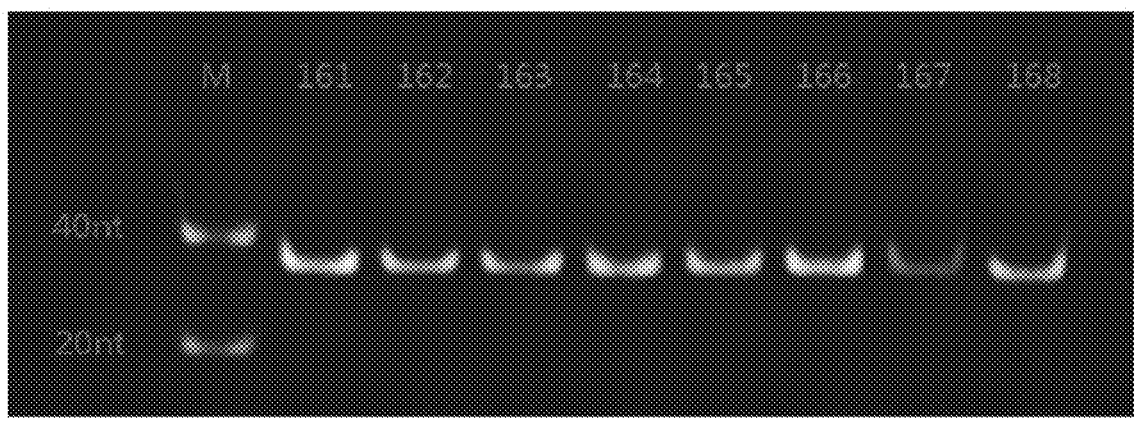
FIG. 1u illustrates the stability of duplexes 161 to 168.
Figure 1V:
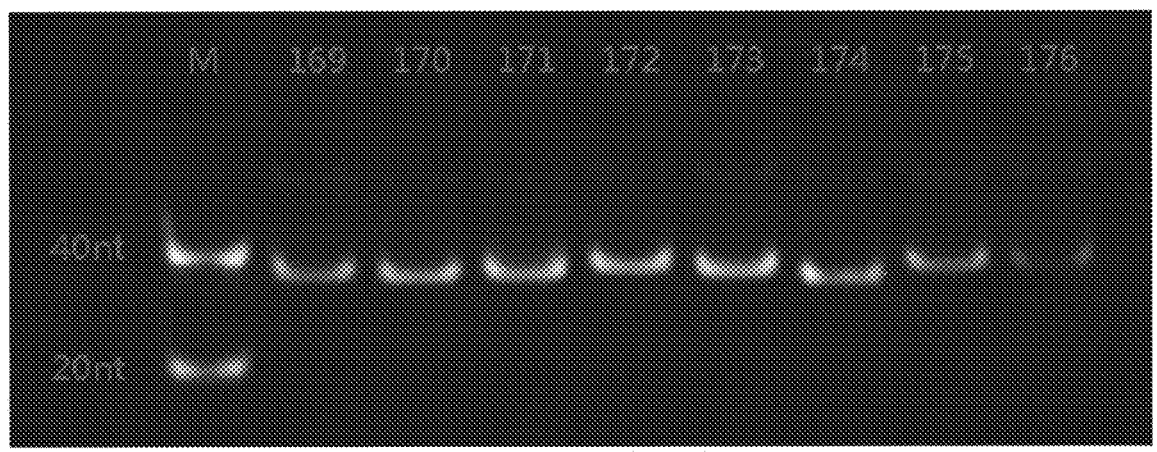
FIG. 1v illustrates the stability of duplexes 169 to 176.
Figure 1W:
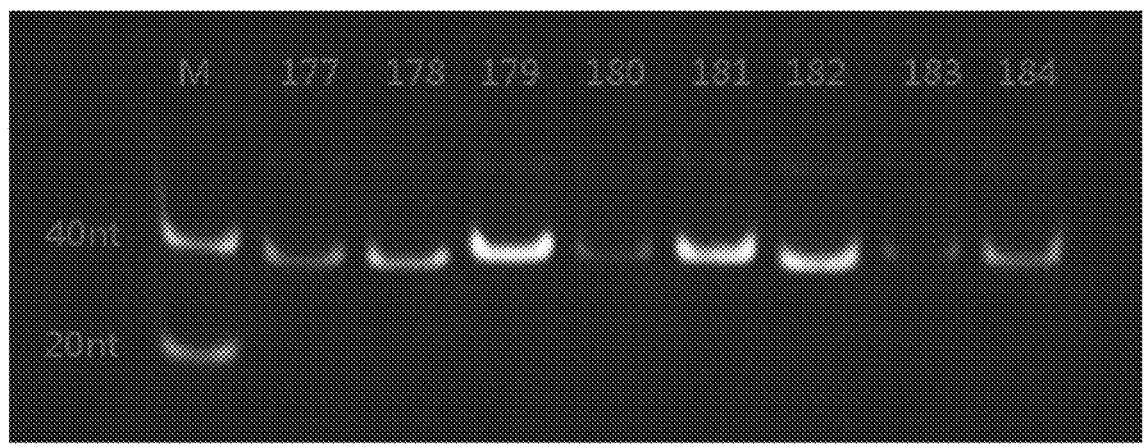
FIG. 1w illustrates the stability of duplexes 177 to 184.
Figure 1X:
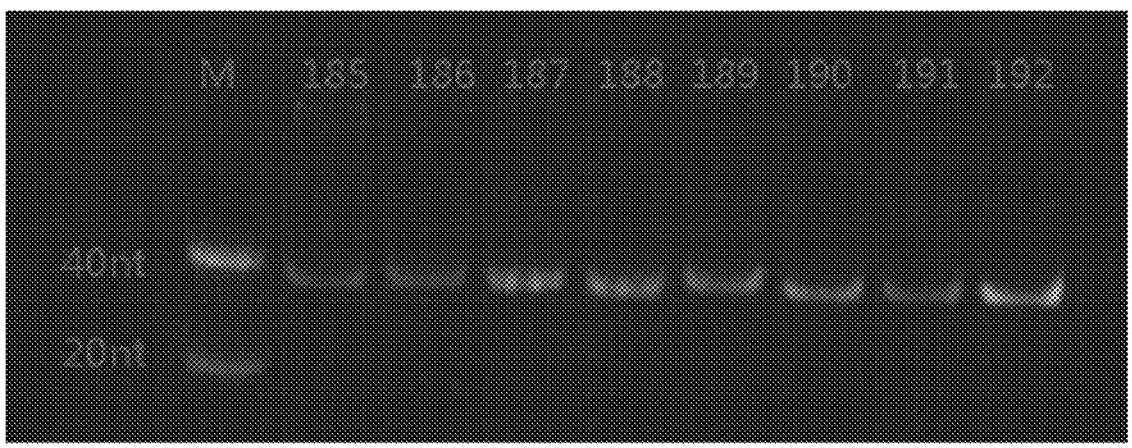
FIG. 1x illustrates the stability of duplexes 185 to 192.
Figure 1Y:
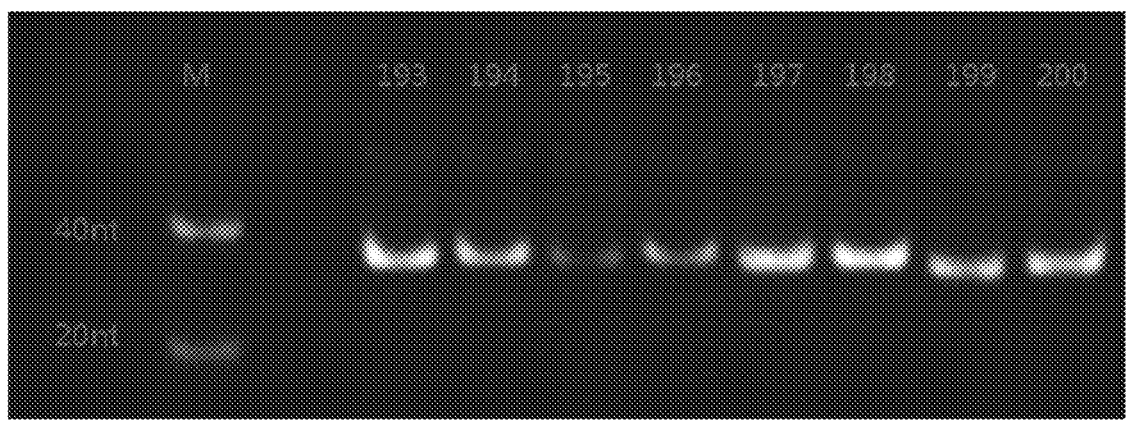
FIG. 1y illustrates the stability of duplexes 193 to 200.
Figure 1Z:
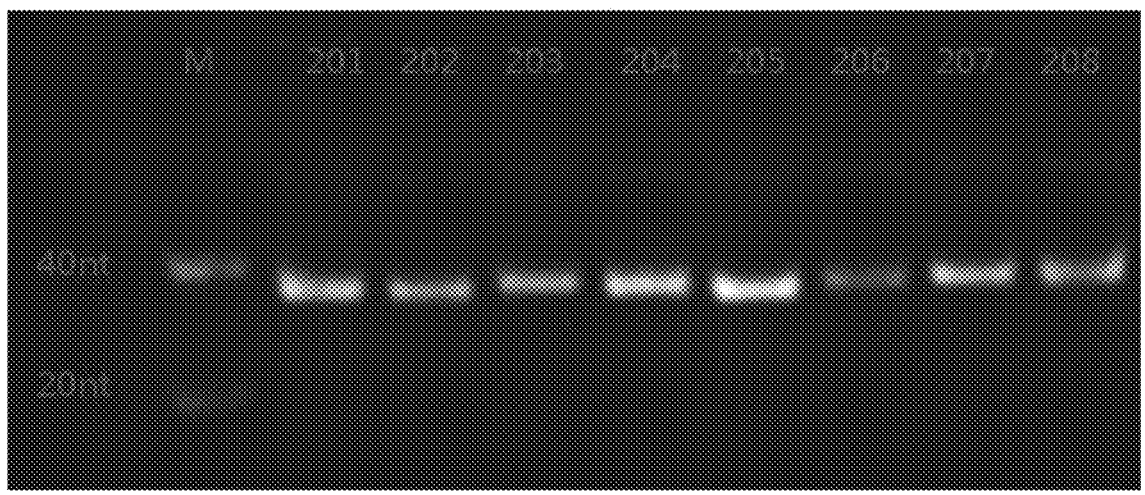
Figure 1Z:
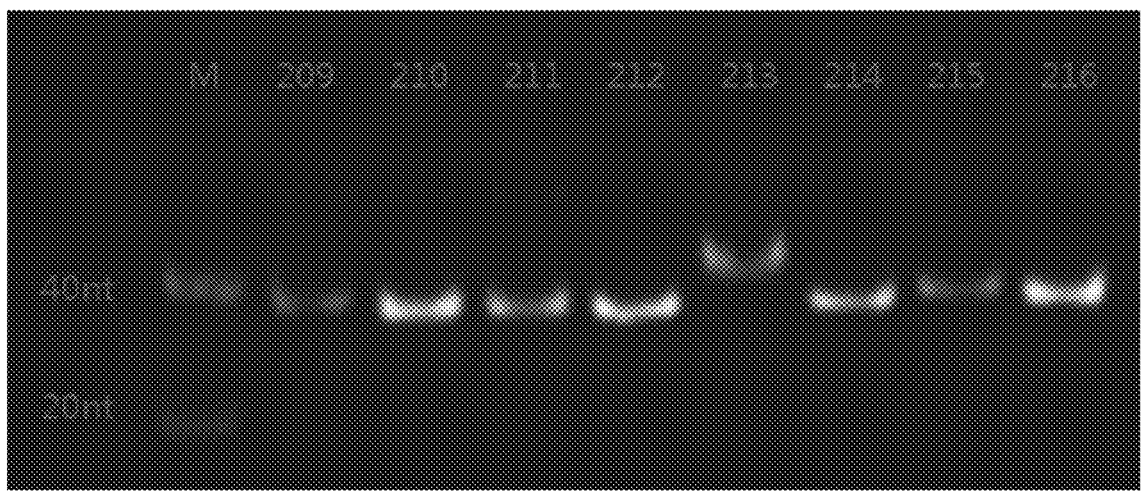
Figure 1Z:
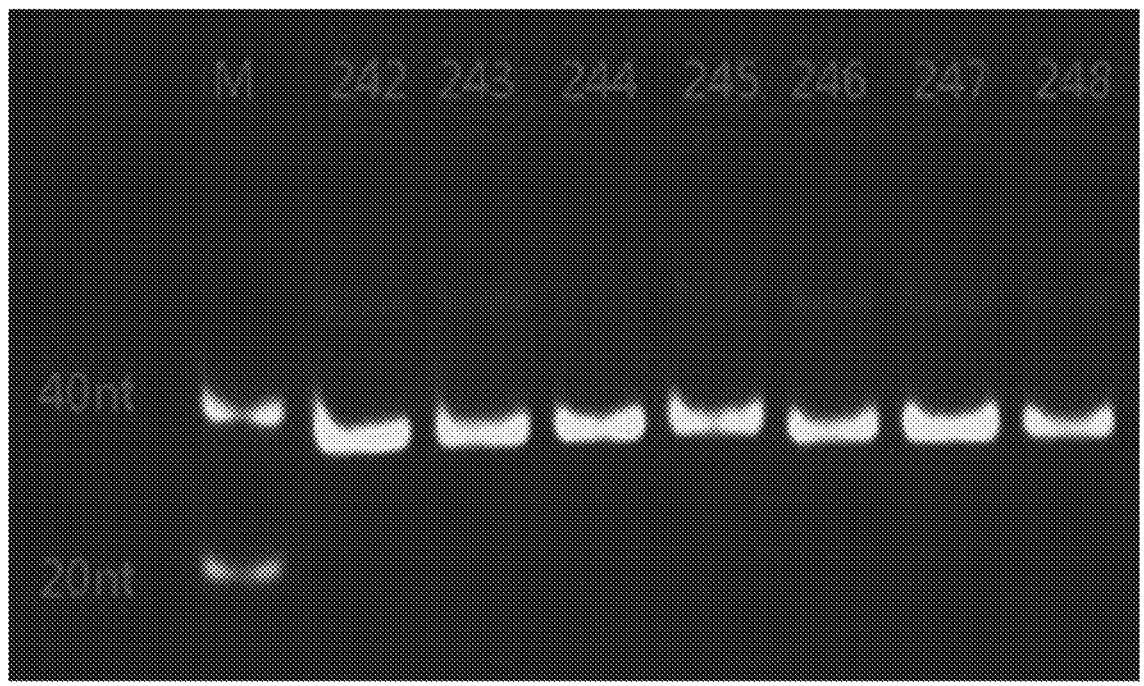

Unless specific definitions are provided, the nomenclature used in connection with, and the procedures and techniques of, analytical chemistry, synthetic organic chemistry, and medicinal and pharmaceutical chemistry described herein are those well known and commonly used in the art. Standard techniques may be used for chemical synthesis, and chemical analysis. Certain such techniques and procedures may be found for example in "Carbohydrate Modifications in Antisense Research" Edited by Sangvi and Cook, American Chemical Society, Washington D.C., 1994; "Remington's Pharmaceutical Sciences," Mack Publishing Co., Easton, Pa., 21$^{st}$ edition, 2005; and "Antisense Drug Technology, Principles, Strategies, and Applications" Edited by Stanley T. Crooke, CRC Press, Boca Raton, Florida; and Sambrook et al., "Molecular Cloning, A laboratory Manual," 2$^{nd}$ Edition, Cold Spring Harbor Laboratory Press, 1989, which are hereby incorporated by reference for any purpose. Where permitted, all patents, applications, published applications and other publications and other data referred to throughout in the disclosure are incorporated by reference herein in their entirety.

Unless otherwise indicated, the following terms have the following meanings:

As used herein, "excipient" means any compound or mixture of compounds that is added to a composition as provided herein that is suitable for delivery of an oligomeric compound.

As used herein, "nucleoside" means a compound comprising a nucleobase moiety and a sugar moiety. Nucleosides include, but are not limited to, naturally occurring nucleosides (as found in DNA and RNA) and modified nucleosides.

Nucleosides may be linked to a phosphate moiety, phosphate-linked nucleosides also being referred to as "nucleotides".

As used herein, "chemical modification" or "chemically modified" means a chemical difference in a compound when compared to a naturally occurring counterpart. Chemical modifications of oligonucleotides include nucleoside modifications (including sugar moiety modifications and nucleobase modifications) and internucleoside linkage modifications. In reference to an oligonucleotide, chemical modification does not include differences only in nucleobase sequence.

As used herein, "furanosyl" means a structure comprising a 5-membered ring comprising four carbon atoms and one oxygen atom.

As used herein, "naturally occurring sugar moiety" means a ribofuranosyl as found in naturally occurring RNA or a deoxyribofuranosyl as found in naturally occurring DNA. A "naturally occurring sugar moiety" as referred to herein is also termed as an "unmodified sugar moiety". In particular, such a "naturally occurring sugar moiety" or an "unmodified sugar moiety" as referred to herein has a —H (DNA sugar moiety) or —OH (RNA sugar moiety) at the 2'-position of the sugar moiety, especially a —H (DNA sugar moiety) at the 2'-position of the sugar moiety.

As used herein, "sugar moiety" means a naturally occurring sugar moiety or a modified sugar moiety of a nucleoside. As used herein, "modified sugar moiety" means a substituted sugar moiety or a sugar surrogate.

As used herein, "substituted sugar moiety" means a furanosyl that has been substituted. Substituted sugar moieties include, but are not limited to furanosyls comprising substituents at the 2'-position, the 3'-position, the 5'-position and/or the 4'-position. Certain substituted sugar moieties are bicyclic sugar moieties.

As used herein, "2'-substituted sugar moiety" means a furanosyl comprising a substituent at the 2'-position other than H or OH. Unless otherwise indicated, a 2'-substituted sugar moiety is not a bicyclic sugar moiety (i.e., the 2'-substituent of a 2'-substituted sugar moiety does not form a bridge to another atom of the furanosyl ring).

As used herein, "MOE" means —OCH$_2$CH$_2$OCH$_3$.

As used herein, "2'-F nucleoside" refers to a nucleoside comprising a sugar comprising fluorine at the 2' position. Unless otherwise indicated, the fluorine in a 2'-F nucleoside is in the ribo position (replacing the OH of a natural ribose). Duplexes of uniformly modified 2'-fluorinated (ribo) oligonucleotides hybridized to RNA strands are not RNase H substrates while the ara analogs retain RNase H activity.

As used herein the term "sugar surrogate" means a structure that does not comprise a furanosyl and that is capable of replacing the naturally occurring sugar moiety of a nucleoside, such that the resulting nucleoside sub-units are capable of linking together and/or linking to other nucleosides to form an oligomeric compound which is capable of hybridizing to a complementary oligomeric compound. Such structures include rings comprising a different number of atoms than furanosyl (e.g., 4, 6, or 7-membered rings); replacement of the oxygen of a furanosyl with a non-oxygen atom (e.g., carbon, sulfur, or nitrogen); or both a change in the number of atoms and a replacement of the oxygen. Such structures may also comprise substitutions corresponding to those described for substituted sugar moieties (e.g., 6-membered carbocyclic bicyclic sugar surrogates optionally comprising additional substituents). Sugar surrogates also include more complex sugar replacements (e.g., the non-ring systems of peptide nucleic acid). Sugar surrogates include without limitation morpholinos, cyclohexenyls and cyclohexitols.

As used herein, "bicyclic sugar moiety" means a modified sugar moiety comprising a 4 to 7 membered ring (including but not limited to a furanosyl) comprising a bridge connecting two atoms of the 4 to 7 membered ring to form a second ring, resulting in a bicyclic structure. In certain embodiments, the 4 to 7 membered ring is a sugar ring. In certain embodiments the 4 to 7 membered ring is a furanosyl. In certain such embodiments, the bridge connects the 2'-carbon and the 4'-carbon of the furanosyl.

As used herein, "nucleotide" means a nucleoside further comprising a phosphate linking group. As used herein, "linked nucleosides" may or may not be linked by phosphate linkages and thus includes, but is not limited to "linked nucleotides." As used herein, "linked nucleosides" are nucleosides that are connected in a continuous sequence (i.e. no additional nucleosides are present between those that are linked).

As used herein, "nucleobase" means a group of atoms that can be linked to a sugar moiety to create a nucleoside that is capable of incorporation into an oligonucleotide, and wherein the group of atoms is capable of bonding with a complementary naturally occurring nucleobase of another oligonucleotide or nucleic acid. Nucleobases may be naturally occurring or may be modified.

As used herein the terms, "unmodified nucleobase" or "naturally occurring nucleobase" means the naturally occurring heterocyclic nucleobases of RNA or DNA: the purine bases adenine (A) and guanine (G), and the pyrimidine bases thymine (T), cytosine (C) (including 5-methyl C), and uracil (U).

As used herein, "modified nucleobase" means any nucleobase that is not a naturally occurring nucleobase.

As used herein, "modified nucleoside" means a nucleoside comprising at least one chemical modification compared to naturally occurring RNA or DNA nucleosides. Modified nucleosides can comprise a modified sugar moiety and/or a modified nucleobase.

As used herein, "bicyclic nucleoside" or "BNA" means a nucleoside comprising a bicyclic sugar moiety.

As used herein, "locked nucleic acid nucleoside" or "LNA" means a nucleoside comprising a bicyclic sugar moiety comprising a 4'-CH$_2$—O-2'bridge.

As used herein, "2'-substituted nucleoside" means a nucleoside comprising a substituent at the 2'-position of the sugar moiety other than H or OH. Unless otherwise indicated, a 2'-substituted nucleoside is not a bicyclic nucleoside.

As used herein, "deoxynucleoside" means a nucleoside comprising 2'—H furanosyl sugar moiety, as found in naturally occurring deoxyribonucleosides (DNA). In certain embodiments, a 2'-deoxynucleoside may comprise a modified nucleobase or may comprise an RNA nucleobase (e.g., uracil).

As used herein, "oligonucleotide" means a compound comprising a plurality of linked nucleosides. In certain embodiments, an oligonucleotide comprises one or more unmodified ribonucleosides (RNA) and/or unmodified deoxyribonucleosides (DNA) and/or one or more modified nucleosides.

As used herein, "modified oligonucleotide" means an oligonucleotide comprising at least one modified nucleoside and/or at least one modified internucleoside linkage.

As used herein, "linkage" or "linking group" means a group of atoms that link together two or more other groups of atoms.

As used herein "internucleoside linkage" means a covalent linkage between adjacent nucleosides in an oligonucleotide.

As used herein "naturally occurring internucleoside linkage" means a 3' to 5' phosphodiester linkage. As used herein, "modified internucleoside linkage" means any internucleoside linkage other than a naturally occurring internucleoside linkage. In particular, a "modified internucleoside linkage" as referred to herein can include a modified phosphorous linking group such as a phosphorothioate or phosphorodithioate internucleoside linkage.

As used herein, "terminal internucleoside linkage" means the linkage between the last two nucleosides of an oligonucleotide or defined region thereof.

As used herein, "phosphorus linking group" means a linking group comprising a phosphorus atom and can include naturally occurring phosphorous linking groups as present in naturally occurring RNA or DNA, such as phosphodiester linking groups, or modified phosphorous linking groups that are not generally present in naturally occurring RNA or DNA, such as phosphorothioate or phosphorodithioate linking groups. Phosphorus linking groups can therefore include without limitation, phosphodiester, phosphorothioate, phosphorodithioate, phosphonate, methylphosphonate, phosphoramidate, phosphorothioamidate, thionoalkylphosphonate, phosphotriesters, thionoalkylphosphotriester and boranophosphate.

As used herein, "internucleoside phosphorus linking group" means a phosphorus linking group that directly links two nucleosides.

As used herein, "oligomeric compound" means a polymeric structure comprising two or more substructures. In certain embodiments, an oligomeric compound comprises an oligonucleotide, such as a modified oligonucletide. In certain embodiments, an oligomeric compound further comprises one or more conjugate groups and/or terminal groups and/or ligands. In certain embodiments, an oligomeric compound consists of an oligonucleotide. In certain embodiments, an oligomeric compound comprises a backbone of one or more linked monomeric sugar moieties, where each linked monomeric sugar moiety is directly or indirectly attached to a heterocyclic base moiety. In certain embodiments, oligomeric compounds may also include monomeric sugar moieties that are not linked to a heterocyclic base moiety, thereby providing abasic sites. Oligomeric compounds may be defined in terms of a nucleobase sequence only, i.e., by specifying the sequence of A, G, C, U (or T). In such a case, the structure of the sugar-phosphate backbone is not particularly limited and may or may not comprise modified sugars and/or modified phosphates. On the other hand, oligomeric compounds may be more comprehensively defined, i.e, by specifying not only the nucleobase sequence, but also the structure of the backbone, in particular the modification status of the sugars (unmodified, 2'-OMe modified, 2'-F modified etc.) and/or of the phosphates.

As used herein, "terminal group" means one or more atom attached to either, or both, the 3'end or the 5' end of an oligonucleotide. In certain embodiments, a terminal group comprises one or more terminal group nucleosides.

As used herein, "conjugate" or "conjugate group" means an atom or group of atoms bound to an oligonucleotide or oligomeric compound. In certain embodiments, a conjugate group links a ligand to a modified oligonucleotide or oligomeric compound. In general, conjugate groups can modify one or more properties of the compound to which they are attached, including, but not limited to pharmacodynamic, pharmacokinetic, binding, absorption, cellular distribution, cellular uptake, charge and/or clearance properties.

As used herein, "conjugate linker" or "linker" in the context of a conjugate group means a portion of a conjugate group comprising any atom or group of atoms and which covalently link an oligonucleotide to another portion of the conjugate group. In certain embodiments, the point of attachment on the oligomeric compound is the 3'-oxygen atom of the 3'-hydroxyl group of the 3' terminal nucleoside of the oligonucleotide. In certain embodiments the point of attachment on the oligomeric compound is the 5'-oxygen atom of the 5'-hydroxyl group of the 5' terminal nucleoside of the oligonucleotide. In certain embodiments, the bond for forming attachment to the oligomeric compound is a cleavable bond. In certain such embodiments, such cleavable bond constitutes all or part of a cleavable moiety.

In certain embodiments, conjugate groups comprise a cleavable moiety (e.g., a cleavable bond or cleavable nucleoside) and ligand portion that can comprise one or more ligands, such as a carbohydrate cluster portion, such as an N-Acetyl-Galactosamine, also referred to as "GalNAc", cluster portion. In certain embodiments, the carbohydrate cluster portion is identified by the number and identity of the ligand. For example, in certain embodiments, the carbohydrate cluster portion comprises 2 GalNAc groups. For example, in certain embodiments, the carbohydrate cluster portion comprises 3 GalNAc groups and this is particularly preferred. In certain embodiments, the carbohydrate cluster portion comprises 4 GalNAc groups. Such ligand portions are attached to an oligomeric compound via a cleavable moiety, such as a cleavable bond or cleavable nucleoside. The ligands can be arranged in a linear or branched configuration, such as a biantennary or triantennary configurations.

As used herein, "cleavable moiety" means a bond or group that is capable of being cleaved under physiological conditions. In certain embodiments, a cleavable moiety is cleaved inside a cell or sub-cellular compartments, such as an endosome or lysosome. In certain embodiments, a cleavable moiety is cleaved by endogenous enzymes, such as nucleases. In certain embodiments, a cleavable moiety comprises a group of atoms having one, two, three, four, or more than four cleavable bonds. In certain embodiments, a cleavable moiety is a phosphodiester linkage.

As used herein, "cleavable bond" means any chemical bond capable of being broken.

As used herein, "carbohydrate cluster" means a compound having one or more carbohydrate residues attached to a linker group.

As used herein, "modified carbohydrate" means any carbohydrate having one or more chemical modifications relative to naturally occurring carbohydrates.

As used herein, "carbohydrate derivative" means any compound which may be synthesized using a carbohydrate as a starting material or intermediate.

As used herein, "carbohydrate" means a naturally occurring carbohydrate, a modified carbohydrate, or a carbohydrate derivative. A carbohydrate is a biomolecule including carbon (C), hydrogen (H) and oxygen (O) atoms. Carbohydrates can include monosaccharide, disaccharides, trisaccharides, tetrasaccharides, oligosaccharides or polysaccharides, such as one or more galactose moieties, one or more lactose moieties, one or more N-Acetyl-Galactosamine moieties, and/or one or more mannose moieties. A particularly preferred carbohydrate is N-Acetyl-Galactosamine moieties.

As used herein, "strand" means an oligomeric compound comprising linked nucleosides. The linker is not particularly limited, but includes phosphodiesters and variants thereof as disclosed herein. A strand may also be viewed as a plurality of linked nucleotides in which case the linker would be a covalent bond.

The term "construct" means a region of linked nucleosides which is defined in terms of nucleobase sequence and sugar modifications. A construct may coincide with a strand or compound, but may also be part thereof.

As used herein, "single strand" or "single-stranded" means an oligomeric compound comprising linked nucleosides that are connected in a continuous sequence without a break therebetween. Such single strands may include regions of sufficient self-complementarity so as to be capable of forming a stable self-duplex in a hairpin structure.

As used herein, "hairpin" means a single stranded oligomeric compound that includes a duplex formed by base pairing between sequences in the strand that are self-complementary and opposite in directionality.

As used herein, "hairpin loop" means an unpaired loop of linked nucleosides in a hairpin that is created as a result of hybridization of the self-complementary sequences. The resulting structure looks like a loop or a U-shape.

In particular, short hairpin RNA, also denoted as shRNA, comprises a duplex region and a loop connecting the regions forming the duplex. The end of the duplex region which does not carry the loop may be blunt-ended or carry (a) 3' and/or (a) 5' overhang(s). Advantageously, the construct is blunt-ended. Such molecules are also referred to as "mxRNAs". As used herein, the term "mxRNA" is in particular understood as defined in WO 2020/044186 A2 which is incorporated by reference herein in its entirety. Particularly preferred hairpin RNAs in accordance with the invention are those shown in Tables 6 and 7 and FIGS. 15 to 18, 20 and 22.

As used herein, "directionality" means the end-to-end chemical orientation of an oligonucleotide based on the chemical convention of numbering of carbon atoms in the sugar moiety meaning that there will be a 5'-end defined by the 5' carbon of the sugar moiety, and a 3'-end defined by the 3' carbon of the sugar moiety. In a duplex or double stranded oligonucleotide, the respective strands run in opposite 5' to 3' directions to permit base pairing between them.

As used herein, "duplex", also abbreviated as "dup", means two or more complementary strand regions, or strands, of an oligonucleotide or oligonucleotides, hybridized together by way of non-covalent, sequence-specific interaction therebetween. Most commonly, the hybridization in the duplex will be between nucleobases adenine (A) and thymine (T), and/or (A) adenine and uracil (U), and/or guanine (G) and cytosine (C). The duplex may be part of a single stranded structure, wherein self-complementarity leads to hybridization, or as a result of hybridization between respective strands in a double stranded molecule.

As used herein, "double strand" or "double stranded" means a pair of oligomeric compounds that are hybridized to one another. In certain embodiments, a double-stranded oligomeric compound comprises a first and a second oligomeric compound.

As used herein, "expression" means the process by which a gene ultimately results in a protein. Expression includes, but is not limited to, transcription, post-transcriptional modification (e.g., splicing, polyadenlyation, addition of 5'-cap), and translation.

As used herein, "transcription" or "transcribed" refers to the first of several steps of DNA based gene expression in which a target sequence of DNA is copied into RNA (especially mRNA) by the enzyme RNA polymerase. During transcription, a DNA sequence is read by an RNA polymerase, which produces a complementary, antiparallel RNA sequence called a primary transcript.

As used herein, "target sequence" means a sequence to which an oligomeric compound is intended to hybridize to result in a desired activity with respect to Factor XI expression. Oligonucleotides have sufficient complementarity to their target sequences to allow hybridization under physiological conditions.

As used herein, "nucleobase complementarity" or "complementarity" when in reference to nucleobases means a nucleobase that is capable of base pairing with another nucleobase. For example, in DNA, adenine (A) is complementary to thymine (T). For example, in RNA, adenine (A) is complementary to uracil (U). In both DNA and RNA, guanine (G) is complementary to cytosine (C). In certain embodiments, complementary nucleobase means a nucleobase of an oligomeric compound that is capable of base pairing with a nucleobase of its target sequence. For example, if a nucleobase at a certain position of an oligomeric compound is capable of hydrogen bonding with a nucleobase at a certain position of a target sequence, then the position of hydrogen bonding between the oligomeric compound and the target sequence is considered to be complementary at that nucleobase pair. Nucleobases comprising certain modifications may maintain the ability to pair with a counterpart nucleobase and thus, are still capable of nucleobase complementarity.

As used herein, "non-complementary" in reference to nucleobases means a pair of nucleobases that do not form hydrogen bonds with one another.

As used herein, "complementary" in reference to oligomeric compounds (e.g., linked nucleosides, oligonucleotides) means the capacity of such oligomeric compounds or regions thereof to hybridize to a target sequence, or to a region of the oligomeric compound itself, through nucleobase complementarity.

Complementary oligomeric compounds need not have nucleobase complementarity at each nucleoside. Rather, some mismatches are tolerated. In certain embodiments, complementary oligomeric compounds or regions are complementary at 70% of the nucleobases (70% complementary). In certain embodiments, complementary oligomeric compounds or regions are 80%>complementary. In certain embodiments, complementary oligomeric compounds or regions are 90%>complementary. In certain embodiments, complementary oligomeric compounds or regions are 95% complementary. In certain embodiments, complementary oligomeric compounds or regions are 100% complementary.

As used herein, "self-complementarity" in reference to oligomeric compounds means a compound that may fold back on itself, creating a duplex as a result of nucleobase hybridization of internal complementary strand regions. Depending on how close together and/or how long the strand regions are, then the compound may form hairpin loops, junctions, bulges or internal loops.

As used herein, "mismatch" means a nucleobase of an oligomeric compound that is not capable of pairing with a nucleobase at a corresponding position of a target sequence, or at a corresponding position of the oligomeric compound itself when the oligomeric compound hybridizes as a result of self-complementarity, when the oligomeric compound and the target sequence and/or self-complementary regions of the oligomeric compound, are aligned.

As used herein, "hybridization" means the pairing of complementary oligomeric compounds (e.g., an oligomeric compound and its target sequence). While not limited to a particular mechanism, the most common mechanism of pairing involves hydrogen bonding, which may be Watson-Crick, Hoogsteen or reversed Hoogsteen hydrogen bonding, between complementary nucleobases.

As used herein, "specifically hybridizes" means the ability of an oligomeric compound to hybridize to one nucleic acid site with greater affinity than it hybridizes to another nucleic acid site.

As used herein, "fully complementary" in reference to an oligomeric compound or region thereof means that each nucleobase of the oligomeric compound or region thereof is capable of pairing with a nucleobase of a complementary nucleic acid target sequence or a self-complementary region of the oligomeric compound. Thus, a fully complementary oligomeric compound or region thereof comprises no mismatches or unhybridized nucleobases with respect to its target sequence or a self-complementary region of the oligomeric compound.

As used herein, "percent complementarity" means the percentage of nucleobases of an oligomeric compound that are complementary to an equal-length portion of a target nucleic acid. Percent complementarity is calculated by dividing the number of nucleobases of the oligomeric compound that are complementary to nucleobases at corresponding positions in the target nucleic acid by the total length of the oligomeric compound.

As used herein, "percent identity" means the number of nucleobases in a first nucleic acid that are the same type (independent of chemical modification) as nucleobases at corresponding positions in a second nucleic acid, divided by the total number of nucleobases in the first nucleic acid.

As used herein, "modulation" means a change of amount or quality of a molecule, function, or activity when compared to the amount or quality of a molecule, function, or activity prior to modulation. For example, modulation includes the change, either an increase (stimulation or induction) or a decrease (inhibition or reduction) in gene expression.

As used herein, "type of modification" in reference to a nucleoside or a nucleoside of a "type" means the chemical modification of a nucleoside and includes modified and unmodified nucleosides. Accordingly, unless otherwise indicated, a "nucleoside having a modification of a first type" may be an unmodified nucleoside.

As used herein, "differently modified" mean chemical modifications or chemical substituents that are different from one another, including absence of modifications. Thus, for example, a MOE nucleoside and an unmodified naturally occurring RNA nucleoside are "differently modified," even though the naturally occurring nucleoside is unmodified. Likewise, DNA and RNA oligonucleotides are "differently modified," even though both are naturally-occurring unmodified nucleosides. Nucleosides that are the same but for comprising different nucleobases are not differently modified. For example, a nucleoside comprising a 2'—OMe modified sugar moiety and an unmodified adenine nucleobase and a nucleoside comprising a 2'-OMe modified sugar moiety and an unmodified thymine nucleobase are not differently modified.

As used herein, "the same type of modifications" refers to modifications that are the same as one another, including absence of modifications. Thus, for example, two unmodified RNA nucleosides have "the same type of modification," even though the RNA nucleosides are unmodified. Such nucleosides having the same type modification may comprise different nucleobases.

As used herein, "region" or "regions", or "portion" or "portions", mean a plurality of linked nucleosides that have a function or character as defined herein, in particular with reference to the subject-matter and definitions described herein. Typically such regions or portions comprise at least 10, at least 11, at least 12 or at least 13 linked nucleosides. For example, such regions can comprise 13 to 20 linked nucleosides, such as 13 to 16 or 18 to 20 linked nucleosides. Typically a first region as defined herein consists essentially of 18 to 20 nucleosides and a second region as defined herein consists essentially of 13 to 16 linked nucleosides.

As used herein, "pharmaceutically acceptable carrier or diluent" means any substance suitable for use in administering to an animal. In certain embodiments, a pharmaceutically acceptable carrier or diluent is sterile saline. In certain embodiments, such sterile saline is pharmaceutical grade saline.

As used herein, "substituent" and "substituent group," means an atom or group that replaces the atom or group of a named parent compound. For example a substituent of a modified nucleoside is any atom or group that differs from the atom or group found in a naturally occurring nucleoside (e.g., a modified 2'-substituent is any atom or group at the 2'-position of a nucleoside other than H or OH). Substituent groups can be protected or unprotected. In certain embodiments, compounds of the present disclosure have substituents at one or at more than one position of the parent compound. Substituents may also be further substituted with other substituent groups and may be attached directly or via a linking group such as oxygen or an alkyl or hydrocarbyl group to a parent compound.

Such substituents can be present as the modification on the sugar moiety, in particular a substituent present at the 2'-position of the sugar moiety. Unless otherwise indicated, groups amenable for use as substituents include without limitation, one or more of halo, hydroxyl, alkyl, alkenyl, alkynyl, acyl, carboxyl, alkoxy, alkoxyalkylene and amino substituents. Certain substituents as described herein can represent modifications directly attached to a ring of a sugar moiety (such as a halo, such as fluoro, directly attached to a sugar ring), or a modification indirectly linked to a ring of a sugar moiety by way of an oxygen linking atom that itself is directly linked to the sugar moiety (such as an alkoxyalkylene, such as methoxyethylene, linked to an oxygen atom, overall providing an MOE substituent as described herein attached to the 2'-position of the sugar moiety).

As used herein, "alkyl," as used herein, means a saturated straight or branched monovalent $C_{1-6}$ hydrocarbon radical, with methyl being a most preferred alkyl as a substituent at the 2'-position of the sugar moiety. The alkyl group typically attaches to an oxygen linking atom at the 2' position of the sugar, therefore, overall providing an —O-alkyl substituent, such as an —OCH$_3$ substituent, on a sugar moiety of an oligomeric compound as described herein. This will be well understood be a person skilled in the art.

As used herein, "alkylene" means a saturated straight or branched divalent hydrocarbon radical of the general formula —C$_n$H$_{2n}$— where n is 1-6. Methylene or ethylene are preferred alkylenes.

As used herein, "alkenyl" means a straight or branched unsaturated monovalent $C_{2-6}$ hydrocarbon radical, with ethenyl or propenyl being most preferred alkenyls as a substituent at the 2'-position of the sugar moiety. As will be well understood in the art, the degree of unsaturation that is present in an alkenyl radical is the presence of at least one carbon to carbon double bond. The alkenyl group typically attaches to an oxygen linking atom at the 2'-position of the sugar, therefore, overall providing a —Oalkenyl substituent, such as an —OCH$_2$CH=CH$_2$ substituent, on a sugar moiety of an oligomeric compound as described herein. This will be well understood be a person skilled in the art.

As used herein, "alkynyl" means a straight or branched unsaturated C$_{2-6}$ hydrocarbon radical, with ethynyl being a most preferred alkynyl as a substituent at the 2'-position of the sugar moiety. As will be well understood in the art, the degree of unsaturation that is present in an alkynyl radical is the presence of at least one carbon to carbon triple bond. The alkynyl group typically attaches to an oxygen linking atom at the 2'-position of the sugar, therefore, overall providing a —Oalkynyl substituent on a sugar moiety of an oligomeric compound as described herein. This will be well understood be a person skilled in the art.

As used herein, "carboxyl" is a radical having a general formula —CO$_2$H.

As used herein, "acyl" means a radical formed by removal of a hydroxyl group from a carboxyl radical as defined herein and has the general Formula —C(O)—X where X is typically C$_{1-6}$ alkyl.

As used herein, "alkoxy" means a radical formed between an alkyl group, such as a C$_{1-6}$ alkyl group, and an oxygen atom wherein the oxygen atom is used to attach the alkoxy group either to a parent molecule (such as at the 2'-position of a sugar moiety), or to another group such as an alkylene group as defined herein. Examples of alkoxy groups include without limitation, methoxy, ethoxy, propoxy, isopropoxy, n-butoxy, sec-butoxy and tert-butoxy. Alkoxy groups as used herein may optionally include further substituent groups.

As used herein, alkoxyalkylene means an alkoxy group as defined herein that is attached to an alkylene group also as defined herein, and wherein the oxygen atom of the alkoxy group attaches to the alkylene group and the alkylene attaches to a parent molecule. The alkylene group typically attaches to an oxygen linking atom at the 2'-position of the sugar, therefore, overall providing a-Oalkylenealkoxy substituent, such as an —OCH$_2$CH$_2$OCH$_3$ substituent, on a sugar moiety of an oligomeric compound as described herein. This will be well understood by a person skilled in the art and is generally referred to as an MOE substituent as defined herein and as known in the art.

As used herein, "amino" includes primary, secondary and tertiary amino groups.

As used herein, "halo" and "halogen," mean an atom selected from fluorine, chlorine, bromine and iodine.

It will also be understood that oligomeric compounds as described herein may have one or more non-hybridizing nucleosides at one or both ends of one or both strands (overhangs) and/or one or more internal non-hybridizing nucleosides (mismatches) provided there is sufficient complementarity to maintain hybridization under physiologically relevant conditions. Alternatively, oligomeric compounds as described herein may be blunt ended at at least one end.

The term "comprising" is used herein to mean including the method steps or elements identified, but that such steps or elements do not comprise an exclusive list and as such there may be present additional steps or elements.

Further, to the extent that the term "includes" is used in either the detailed description or the claims, such term is intended to be inclusive in a manner similar to the term "comprising" as "comprising" is interpreted when employed as a transitional word in a claim.

Each of the constructs of the invention may or may not have a phosphate modification at the 5' end group. Furthermore, and independently, each of the above constructs may or may not have a "3x GalNAc" coupled to the 3' end group. Advantageously, a construct bears a 3x GalNAc ligand, such as a "toothbrush" moiety as disclosed herein. Particularly preferred are constructs which in addition have a 5' phosphate, even though this is not a strict requirement, given that in the absence thereof, mammalian cells will add such phosphate in case it is absent from the molecule as administered.

The following are aspects of the present embodiments.

Aspect 1. An oligomeric compound capable of modulating, preferably inhibiting, expression of FXI, wherein the compound comprises at least a first region of linked nucleosides having at least a first nucleobase sequence that is at least partially complementary to at least a portion of RNA transcribed from an FXI gene, wherein the first nucleobase sequence is selected from the following sequences, or a portion thereof: SEQ ID NOs 1 to 250, or SEQ ID NOs 1251 to 1500 and 2295.

Aspect 2. An oligomeric compound according to aspect 1, which further comprises at least a second region of linked nucleosides having at least a second nucleobase sequence that is at least partially complementary to the first nucleobase sequence and is selected from the following sequences, or a portion thereof: SEQ ID NOs 251 to 500, or SEQ ID NOs 1501 to 1750.

Aspect 3. An oligomeric compound according to aspect 1 or 2, wherein the first nucleobase sequence is selected from the following sequences, or a portion thereof: SEQ ID NOs 8, 13, 27, 39, 46, 91, 98, 103, 105, 109, 120, 140, 146, 151, 152, 163, 182, 183, 199, 207, 210, 218, 220, 223, 224, 238, or SEQ ID NOs 1258, 1263, 1277, 1289, 1296, 1341, 1348, 1353, 1355, 1359, 1370, 1390, 1396, 1401, 1402, 1413, 1432, 1433, 1449, 1457, 1460, 1468, 1470, 1473, 1474, 1488.

Aspect 4. An oligomeric compound according to aspect 3, wherein the second nucleobase sequence is selected from the following sequences, or a portion thereof: SEQ ID NOs 258, 263, 277, 289, 296, 341, 348, 353, 355, 359, 370, 390, 396, 401, 402, 413, 432, 433, 449, 457, 460, 468, 470, 473, 474, 488, or SEQ ID NOs 1508, 1513, 1527, 1539, 1546, 1591, 1598, 1603, 1605, 1609, 1620, 1640, 1646, 1651, 1652, 1663, 1682, 1683, 1699, 1707, 1710, 1718, 1720, 1723, 1724, 1738.

Aspect 5. An oligomeric compound according to any of aspects 1 to 4, wherein the first nucleobase sequence is selected from the following sequences, or a portion thereof: SEQ ID NOS 8, 46, 91, 146, 152, 207, or SEQ ID NOs 1258, 1296, 1341, 1396, 1402, 1457.

Aspect 6. An oligomeric compound according to aspect 5, wherein the second nucleobase sequence is selected from the following sequences, or a portion thereof: SEQ ID NOs 258, 296, 341, 396, 402, 457, or SEQ ID NOs 1508, 1546, 1591, 1646, 1652, 1707.

Aspect 7. An oligomeric compound according to any of aspects 1 to 6, wherein the first nucleobase sequence is selected from the following sequences, or a portion thereof: SEQ ID NOS 46, 91, 152, or SEQ ID NOs 1296, 1341, 1402.

Aspect 8. An oligomeric compound according to aspect 7, wherein the second nucleobase sequence is selected from the following sequences, or a portion thereof: SEQ ID NOs 296, 341, 402, or SEQ ID NOS 1546, 1591, 1652.

Aspect 9. An oligomeric compound according to any of aspects 1 to 8, wherein the first nucleobase sequence is at least partially complementary to any of the following sequences, or a portion thereof: SEQ ID NOs 1001 to 1250 and 2293-2294.

Aspect 10. An oligomeric compound according to aspect 3 and/or 4, wherein the first nucleobase sequence is at least partially complementary to any of the following sequences, or a portion thereof: SEQ ID NOs 1008, 1013, 1027, 1039, 1046, 1091, 1098, 1103, 1105, 1109, 1120, 1140, 1146, 1151, 1152, 1163, 1182, 1183, 1199, 1207, 1210, 1218, 1220, 1223, 1224, 1238.

Aspect 11. An oligomeric compound according to aspect 5 and/or 6, wherein the first nucleobase sequence is at least partially complementary to any of the following sequences, or a portion thereof: SEQ ID NOs 1008, 1046, 1091, 1146, 1152, 1207.

Aspect 12. An oligomeric compound according to aspect 7 and/or 8, wherein the first nucleobase sequence is at least partially complementary to any of the following sequences, or a portion thereof: SEQ ID NOs 1046, 1091, 1152.

Aspect 13. An oligomeric compound capable of modulating, preferably inhibiting, expression of FXI, which compound comprises at least a first region of linked nucleosides having at least a first nucleobase sequence that is at least partially complementary to at least a portion of RNA transcribed from an FXI gene, wherein the RNA is selected from the following sequences, or a portion thereof: SEQ ID NOS 1001 to 1250 and 2293-2294.

Aspect 14. An oligomeric compound according to aspect 13, wherein the RNA is selected from the following sequences, or a portion thereof: SEQ ID NOs 1008, 1013, 1027, 1039, 1046, 1091, 1098, 1103, 1105, 1109, 1120, 1140, 1146, 1151, 1152, 1163, 1182, 1183, 1199, 1207, 1210, 1218, 1220, 1223, 1224, 1238.

Aspect 15. An oligomeric compound according to aspect 13 or 14, wherein the RNA is selected from the following sequences, or a portion thereof: SEQ ID NOs 1008, 1046, 1091, 1146, 1152, 1207.

Aspect 16. An oligomeric compound according to any of aspects 13 to 15, wherein the RNA is selected from the following sequences, or a portion thereof: SEQ ID NOs 1046, 1091, 1152.

Aspect 17. An oligomeric compound according to any of aspects 1 to 16, wherein the first region of linked nucleosides consists essentially of 18 to 20 linked nucleosides.

Aspect 18. An oligomeric compound according to any of aspects 2 to 17, wherein the second region of linked nucleosides consists essentially of 11 to 16, advantageously 12 to 15 or 13 to 16 linked nucleosides.

Aspect 19. An oligomeric compound according to any of aspects 2 to 18, which comprises at least one complementary duplex region that comprises at least a portion of the first nucleoside region directly or indirectly linked to at least a portion of the second nucleoside region.

Aspect 20. An oligomeric compound according to aspect 19, wherein each of the first and second nucleoside regions has a 5' to 3' directionality thereby defining 5' and 3' regions respectively thereof.

Aspect 21. An oligomeric compound according to aspect 20, wherein the 5' region of the first nucleoside region is directly or indirectly linked to the 3' region of the second nucleoside region, for example by complementary base pairing, and/or wherein the 3' region of the first nucleoside region is directly or indirectly linked to the 5' region of the second nucleoside region.

Aspect 22. An oligomeric compound according to any of aspects 1 to 21, which further comprises one or more ligands.

Aspect 23. An oligomeric compound according to aspect 21, wherein the one or more ligands are conjugated to the second nucleoside region.

Aspect 24. An oligomeric compound according to aspect 23, as dependent on aspect 20, wherein the one or more ligands are conjugated at the 3'region of the second nucleoside region.

Aspect 25. An oligomeric compound according to any of aspects 22 to 24, wherein the one or more ligands are any cell directing moiety, such as lipids, carbohydrates, aptamers, vitamins and/or peptides that bind cellular membrane or a specific target on cellular surface.

Aspect 26. An oligomeric compound according to aspect 25, wherein the one or more ligands comprise one or more carbohydrates.

Aspect 27. An oligomeric compound according to aspect 26, wherein the one or more carbohydrates can be a monosaccharide, disaccharide, trisaccharide, tetrasaccharide, oligosaccharide or polysaccharide.

Aspect 28. An oligomeric compound according to aspect 27, wherein the one or more carbohydrates comprise one or more galactose moieties, one or more lactose moieties, one or more N-Acetyl-Galactosamine moieties, and/or one or more mannose moieties.

Aspect 29. An oligomeric compound according to aspect 28, wherein the one or more carbohydrates comprise one or more N-Acetyl-Galactosamine moieties.

Aspect 30. An oligomeric compound according to aspect 29, which comprises two or three N-Acetyl-Galactosamine moieties, preferably three.

Aspect 31. An oligomeric compound according to any of aspects 22 to 30, wherein the one or more ligands are attached to the oligomeric compound, preferably to the second nucleoside region thereof, in a linear configuration, or in a branched configuration.

Preferred is that the ligand has the following structure, also referred to as "toothbrush" herein:

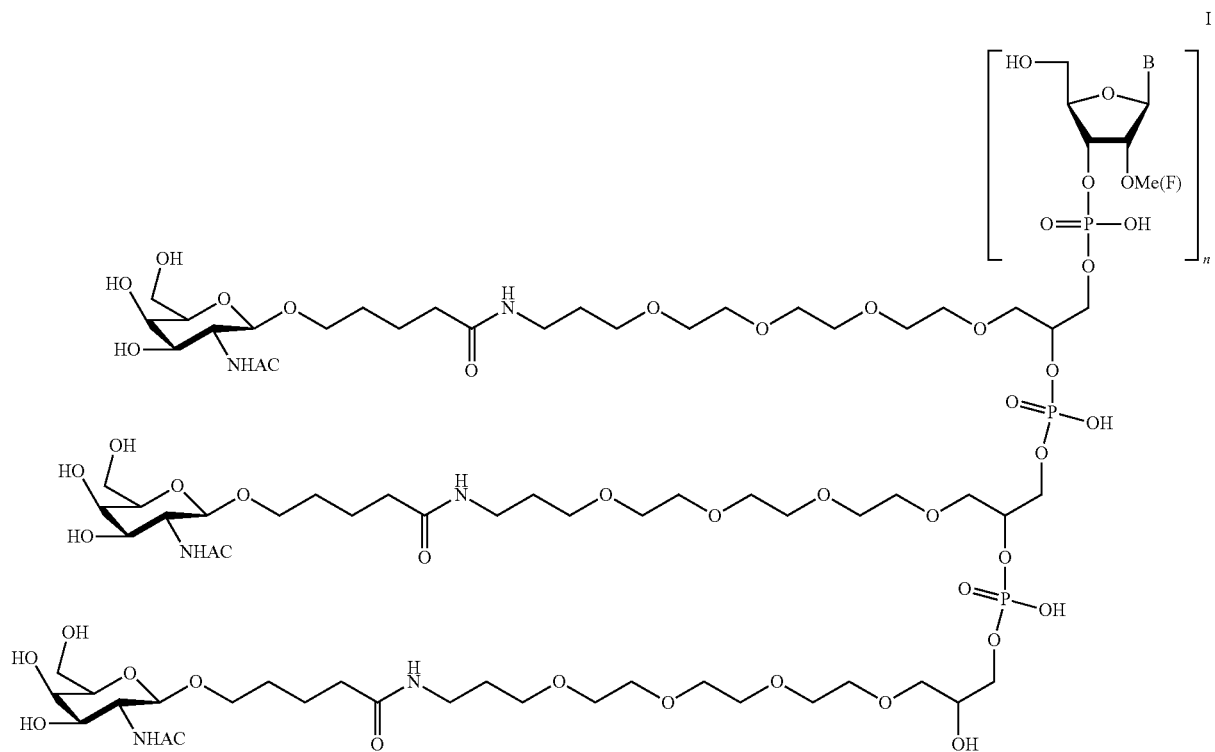

A particularly preferred embodiment of "GalNAc" (as used herein) is the above structure.

Aspect 32. An oligomeric compound according to aspect 31, wherein the one or more ligands are attached to the oligomeric compound as a biantennary or triantennary configuration.

Aspect 33. An oligomeric compound according to aspect 19, wherein the oligomeric compound comprises a single strand comprising the first and second nucleoside regions, wherein the single strand dimerises whereby at least a portion of the first nucleoside region is directly or indirectly linked to at least a portion of the second nucleoside region so as to form the at least partially complementary duplex region.

Aspect 34. An oligomeric compound according to aspect 33, wherein the first nucleoside region has a greater number of linked nucleosides compared to the second nucleoside region, whereby the additional number of linked nucleosides of the first nucleoside region form a hairpin loop linking the first and second nucleoside regions.

Aspect 35. An oligomeric compound according to aspect 34, as dependent on aspect 20, whereby the hairpin loop is present at the 3' region of the first nucleoside region.

Aspect 36. An oligomeric compound according to aspect 34 or 35, wherein the hairpin loop comprises 4 or 5 linked nucleosides.

Aspect 37. An oligomeric compound according to any of aspects 1 to 36, which comprises internucleoside linkages and wherein at least one internucleoside linkage is a modified internucleoside linkage.

Aspect 38. An oligomeric compound according to aspect 37, wherein the modified internucleoside linkage is a phosphorothioate or phosphorodithioate internucleoside linkage.

Aspect 39. An oligomeric compound according to aspect 38, which comprises 1 to 15 phosphorothioate or phosphorodithioate internucleoside linkages.

Aspect 40. An oligomeric compound according to aspect 39, which comprises 7, 8, 9 or 10 phosphorothioate or phosphorodithioate internucleoside linkages.

Aspect 41. An oligomeric compound according to any of aspects 38 to 40, as dependent on aspect 20, which comprises one or more phosphorothioate or phosphorodithioate internucleoside linkages at the 5' region of the first nucleoside region.

Aspect 42. An oligomeric compound according to any of aspects 38 to 41, as dependent on aspect 20, which comprises one or more phosphorothioate or phosphorodithioate internucleoside linkages at the 5' region of the second nucleoside region.

Aspect 43. An oligomeric compound according to any of aspects 38 to 42, as dependent on aspect 34, which comprises phosphorothioate or phosphorodithioate internucleoside linkages between at least two, preferably at least three, preferably at least four, preferably at least five, adjacent nucleosides of the hairpin loop, dependent on the number of nucleotides present in the hairpin loop.

Aspect 44. An oligomeric compound according to aspect 43, which comprises a phosphorothioate or phosphorodithioate internucleoside linkage between each adjacent nucleoside that is present in the hairpin loop.

Aspect 45. An oligomeric compound according to any of aspects 1 to 44, wherein at least one nucleoside comprises a modified sugar.

Aspect 46. An oligomeric compound according to aspect 45, wherein the modified sugar is selected from 2' modified sugars; conformationally restricted nucleotides (CRN) sugar such as locked nucleic acid (LNA), (S)-constrained ethyl bicyclic nucleic acid, and constrained ethyl (cEt), tricyclo-DNA; morpholino, unlocked nucleic acid (UNA), glycol nucleic acid (GNA), D-hexitol nucleic acid (HNA), and cyclohexene nucleic acid (CeNA), and preferably is a 2'-O-methyl modified sugar.

Further 2' modified sugars include 2'-O-alkyl modified sugar, 2'-O-methoxyethyl modified sugar, 2'-O-allyl modified sugar, 2'-C-allyl modified sugar, 2'-deoxy modified sugar such as 2'-deoxy ribose, 2'-F modified sugar, 2'-arabino-fluoro modified sugar, 2'-O-benzyl modified sugar, 2'-amino modified sugar, and 2'-O-methyl-4-pyridine modified sugar.

Aspect 47. An oligomeric compound according to aspect 45 or 46, wherein the modified sugar is a 2'-F modified sugar.

Aspect 48. An oligomeric compound according to any of aspects 45 to 47, as dependent on aspect 20, wherein sugars of the nucleosides at any of positions 2 and 14 downstream from the first nucleoside of the 5' region of the first nucleoside region, do not contain 2'-O-methyl modifications.

Aspect 49. An oligomeric compound according to any of aspects 45 to 48, as dependent on aspect 20, wherein sugars of the nucleosides of the second nucleoside region, that correspond in position to any of the nucleosides of the first nucleoside region at any of positions 9 to 11 downstream from the first nucleotide of the 5' region of the first nucleoside region, do not contain 2'-O-methyl modifications.

Aspect 50. An oligomeric compound according to aspect 48 or 49, wherein sugars of the nucleosides at any of positions 2 and 14 downstream from the first nucleoside of the 5' region of the first nucleoside region, contain 2'-F modifications.

Aspect 51. An oligomeric compound according to any of aspects 48 to 50, wherein sugars of the nucleosides of the second nucleoside region, that correspond in position to any of the nucleosides of the first nucleoside region at any of positions 9 to 11 downstream from the first nucleoside of the 5' region of the first nucleoside region, contain 2'-F modifications.

Aspect 52. An oligomeric compound according to any of aspects 45 to 51, as dependent on aspect 20, wherein one or more of the odd numbered nucleosides starting from the 5' region of the first nucleoside region are modified, and/or wherein one or more of the even numbered nucleotides starting from the 5' region of the first nucleoside region are modified, wherein typically the modification of the even numbered nucleotides is a second modification that is different from the modification of odd numbered nucleotides.

Aspect 53. An oligomeric compound according to aspect 52, wherein one or more of the odd numbered nucleosides starting from the 3' region of the second nucleoside region are modified by a modification that is different from the modification of odd numbered nucleosides of the first nucleoside region.

Aspect 54. An oligomeric compound according to aspect 52 or 53, wherein one or more of the even numbered nucleosides starting from the 3' region of the second nucleoside region are modified by a modification that is different from the modification of even numbered nucleosides of the first nucleoside region according to aspect 53.

Aspect 55. An oligomeric compound according to any of aspects 52 to 54, wherein at least one or more of the modified even numbered nucleosides of the first nucleoside region is adjacent to at least one or more of the differently modified odd numbered nucleosides of the first nucleoside region.

Aspect 56. An oligomeric compound according to any of aspects 52 to 55, wherein at least one or more of the modified even numbered nucleosides of the second nucleoside region is adjacent to at least one or more of the differently modified odd numbered nucleosides of the second nucleoside region.

Aspect 57. An oligomeric compound according to any of aspects 52 to 56, wherein sugars of one or more of the odd numbered nucleosides starting from the 5' region of the first nucleoside region are 2'-O-methyl modified sugars.

Aspect 58. An oligomeric compound according to any of aspects 52 to 57, wherein one or more of the even numbered nucleosides starting from the 5' region of the first nucleoside region are 2'-F modified sugars.

Aspect 59. An oligomeric compound according to any of aspects 52 to 58, wherein sugars of one or more of the odd numbered nucleosides starting from the 3' region of the second nucleoside region are 2'-F modified sugars.

Aspect 60. An oligomeric compound according to any of aspects 52 to 59, wherein one or more of the even numbered nucleosides starting from the 3' region of the second nucleoside region are 2'-O-methyl modified sugars.

Aspect 61. An oligomeric compound according to any of aspects 45 to 60, wherein sugars of a plurality of adjacent nucleosides of the first nucleoside region are modified by a common modification.

Aspect 62. An oligomeric compound according to any of aspects 45 to 61, wherein sugars of a plurality of adjacent nucleosides of the second nucleoside region are modified by a common modification.

Aspect 63. An oligomeric compound according to any of aspects 52 to 62, as dependent on aspect 34, wherein sugars of a plurality of adjacent nucleosides of the hairpin loop are modified by a common modification.

Aspect 64. An oligomeric compound according to any of aspects 61 to 63, wherein the common modification is a 2'-F modified sugar.

Aspect 65. An oligomeric compound according to any of aspects 61 to 63, wherein the common modification is a 2'-O-methyl modified sugar.

Aspect 66. An oligomeric compound according to aspect 65, wherein the plurality of adjacent 2'-O-methyl modified sugars are present in at least eight adjacent nucleosides of the first and/or second nucleoside regions.

Aspect 67. An oligomeric compound according to aspect 65, wherein the plurality of adjacent 2'-O-methyl modified sugars are present in three or four adjacent nucleosides of the hairpin loop.

Aspect 68. An oligomeric compound according to aspect 45, as dependent on aspect 34, wherein the hairpin loop comprises at least one nucleoside having a modified sugar.

Aspect 69. An oligomeric compound according to aspect 68, wherein the at least one nucleoside is adjacent a nucleoside with a differently modified sugar.

Aspect 70. An oligomeric compound according to aspect 69, wherein the modified sugar is a 2'-O-methyl modified sugar, and the differently modifies sugar is a 2'-F modified sugar.

Aspect 71. An oligomeric compound according to any of aspects 1 to 70, which comprises one or more nucleosides having an un-modified sugar moiety.

Aspect 72. An oligomeric compound according to aspect 71, wherein the unmodified sugar is present in the 5' region of the second nucleoside region.

Aspect 73. An oligomeric compound according to aspect 71 or 72, as dependent on aspect 34, wherein the unmodified sugar is present in the hairpin loop.

Aspect 74. An oligomeric compound according to any of aspects 1 to 73, wherein one or more nucleosides of the first nucleoside region and/or the second nucleoside region is an inverted nucleoside and is attached to an adjacent nucleoside via the 3' carbon of its sugar and the 3' carbon of the sugar of the adjacent nucleoside, and/or one or more nucleosides of the first nucleoside region and/or the second nucleoside region is an inverted nucleoside and is attached to an adjacent nucleoside via the 5' carbon of its sugar and the 5' carbon of the sugar of the adjacent nucleoside.

Aspect 75. An oligomeric compound according to any of aspects 1 to 74, which is blunt ended.

Aspect 76. An oligomeric compound according to any of aspects 1 to 74, wherein either the first or second nucleoside region has an overhang.

Aspect 77. An oligomeric compound capable of modulating, preferably inhibiting, expression of FXI, wherein the compound comprises at least a first region of linked nucleosides having at least a first nucleobase sequence that is at least partially complementary to at least a portion of RNA transcribed from an FXI gene, wherein the first nucleobase sequence is a modified sequence and is selected from the following sequences, or a portion thereof: SEQ ID/construct NOs 501 to 750, or SEQ ID/construct NOs 1751 to 2000.

Aspect 78. An oligomeric compound according to aspect 77, which further comprises at least a second region of linked nucleosides having at least a second nucleobase sequence that is at least partially complementary to the first nucleobase sequence, wherein the second nucleobase sequence is a modified sequence and is selected from the following sequences, or a portion thereof: SEQ ID/construct NOs 751 to 1000, or SEQ ID/construct NOs 2001 to 2250.

Aspect 79. An oligomeric compound according to aspect 77 or 78, wherein the first nucleobase sequence is selected from the following sequences, or a portion thereof: SEQ ID/construct Nos 508, 513, 527, 539, 546, 591, 598, 603, 605, 609, 620, 640, 646, 651, 652, 663, 682, 683, 699, 707, 710, 718, 720, 723, 724, 738, or SEQ ID/construct NOs 1758, 1763, 1777, 1789, 1796, 1841, 1848, 1853, 1855, 1859, 1870, 1890, 1896, 1901, 1902, 1913, 1932, 1933, 1949, 1957, 1960, 1968, 1970, 1973, 1974, 1988.

Aspect 80. An oligomeric compound according to aspect 79, wherein the second nucleobase sequence is selected from the following sequences, or a portion thereof: SEQ ID/construct NOs 758, 763, 777, 789, 796, 841, 848, 853, 855, 859, 870, 890, 896, 901, 902, 913, 932, 933, 949, 957, 960, 968, 970, 973, 974, 988, or SEQ ID/construct NOs 2008, 2013, 2027, 2039, 2046, 2091, 2098, 2103, 2105, 2109, 2120, 2140, 2146, 2151, 2152, 2163, 2182, 2183, 2199, 2207, 2210, 2218, 2220, 2223, 2224, 2238.

Aspect 81. An oligomeric compound according to any of aspects 77 to 80, wherein the first nucleobase sequence is selected from the following sequences, or a portion thereof: SEQ ID/construct NOs 508, 546, 591, 646, 652, 707, or SEQ ID/construct NOs 1758, 1796, 1841, 1896, 1902, 1957.

Aspect 82. An oligomeric compound according to aspect 81, wherein the second nucleobase sequence is selected from the following sequences, or a portion thereof: SEQ ID/construct NOs 758, 796, 841, 896, 902, 957, or SEQ ID/construct NOs 2008, 2046, 2091, 2146, 2152, 2207.

Aspect 83. An oligomeric compound according to any of aspects 77 to 82, wherein the first nucleobase sequence is selected from the following sequences, or a portion thereof: SEQ ID/construct NOs 546, 591, 652, or SEQ ID/construct NOs 1796, 1841, 1902.

Aspect 84. An oligomeric compound according to aspect 83, wherein the second nucleobase sequence is selected from the following sequences, or a portion thereof: SEQ ID/construct NOs 796, 841, 902, or SEQ ID/construct NOs 2046, 2091, 2152.

Aspect 85. An oligomeric compound according to any of aspects 77 to 84, which is further characterised according to any of aspects 17 to 44, or 74 to 76.

Aspect 86. An oligomeric compound capable of modulating, preferably inhibiting, expression of FXI, which is selected from the following sequences: SEQ ID NOs 2251 to 2253, or SEQ ID NOS 2284 to 2288, preferably SEQ ID NO: 2287.

Aspect 87. An oligomeric compound capable of modulating, preferably inhibiting, expression of FXI, which is selected from the following sequences: SEQ ID/construct NOs 2254 to 2283 and 2296-2325.

Aspect 88. An oligomeric compound according to aspect 86 or 87, which further comprises one or more ligands.

Aspect 89. An oligomeric compound according to aspect 88, wherein the one or more ligands are conjugated at the 3 'region of the sequences, preferably at the 3' terminal nucleoside.

Aspect 90. An oligomeric compound according to aspect 88, wherein the one or more ligands are conjugated at non-terminal positions.

Aspect 91. An oligomeric compound according to any of aspects 88 to 90, wherein the one or more ligands are any cell directing moiety, such as lipids, carbohydrates, aptamers, vitamins and/or peptides that bind cellular membrane or a specific target on cellular surface.

Aspect 92. An oligomeric compound according to aspect 91, wherein the one or more ligands comprise one or more carbohydrates.

Aspect 93. An oligomeric compound according to aspect 92, wherein the one or more carbohydrates can be a monosaccharide, disaccharide, trisaccharide, tetrasaccharide, oligosaccharide or polysaccharide.

A preferred monosaccharide is hexose.

Aspect 94. An oligomeric compound according to aspect 93, wherein the one or more carbohydrates comprise one or more galactose moieties, one or more lactose moieties, one or more N-Acetyl-Galactosamine moieties, and/or one or more mannose moieties.

Aspect 95. An oligomeric compound according to aspect 94, wherein the one or more carbohydrates comprise one or more N-Acetyl-Galactosamine moieties.

Aspect 96. An oligomeric compound according to aspect 95, which comprises two or three N-Acetyl-Galactosamine moieties, preferably three.

Aspect 97. An oligomeric compound according to any of aspects 88 to 96, wherein the one or more ligands are attached to the oligomeric compound in a linear configuration, or in a branched configuration.

Aspect 98. An oligomeric compound according to aspect 97, wherein the one or more ligands are attached to the oligomeric compound as a biantennary or triantennary configuration.

Aspect 99. An oligomeric compound according to any of aspects 86 to aspect 98, wherein the sequences self dimerise so as to form an at least partially complementary duplex region.

Aspect 100. An oligomeric compound according to aspect 99, having a nucleobase sequence and structure as shown in any of FIGS. 15 to 17 or 18 to 20, SEQ ID/construct NOs: 2290 to 2292 being preferred, SEQ ID/construct NO: 2290 being particularly preferred.

Aspect 101. A composition comprising an oligomeric compound according to any of aspects 1 to 100, and a physiologically acceptable excipient.

Aspect 102. An oligomeric compound according to any of aspects 1 to 100, for use in therapy.

Aspect 103. An oligomeric compound according to any of aspects 1 to 100, for use in the treatment of a disease or disorder.

Aspect 104. A method of treating a disease or disorder comprising administration of an oligomeric compound according to any of aspects 1 to 100, to an individual in need of treatment.

Aspect 105. A method according to aspect 104, wherein the oligomeric compound is administered subcutaneously or intravenously to the individual.

Aspect 106. Use of an oligomeric compound according to any of aspects 1 to 100, for use in research as a gene function analysis tool.

Aspect 107. Use according to aspect 103, or a method according to aspect 104, wherein the disease or disorder is a thromboembolic disease.

Aspect 108. Use or method according to aspect 107, wherein the thromboembolic disease is selected from the group consisting of deep vein thrombosis, venous or arterial thrombosis, pulmonary embolism, myocardial infarction, stroke, thrombosis associated with chronic kidney disease or end-stage renal disease (ESRD), including thrombosis associated with dialysis, or other procoagulant condition.

Aspect 109. Use or method according to aspect 108, wherein the thromboembolic disease is deep vein thrombosis, pulmonary embolism, or a combination thereof.

Aspect 110. Use of an oligomeric compound according to any of items 1 to 100 in the manufacture of a medicament for a treatment of a disease or disorder. The diseases and disorders are advantageously the same as set forth herein above.

Figure 24:
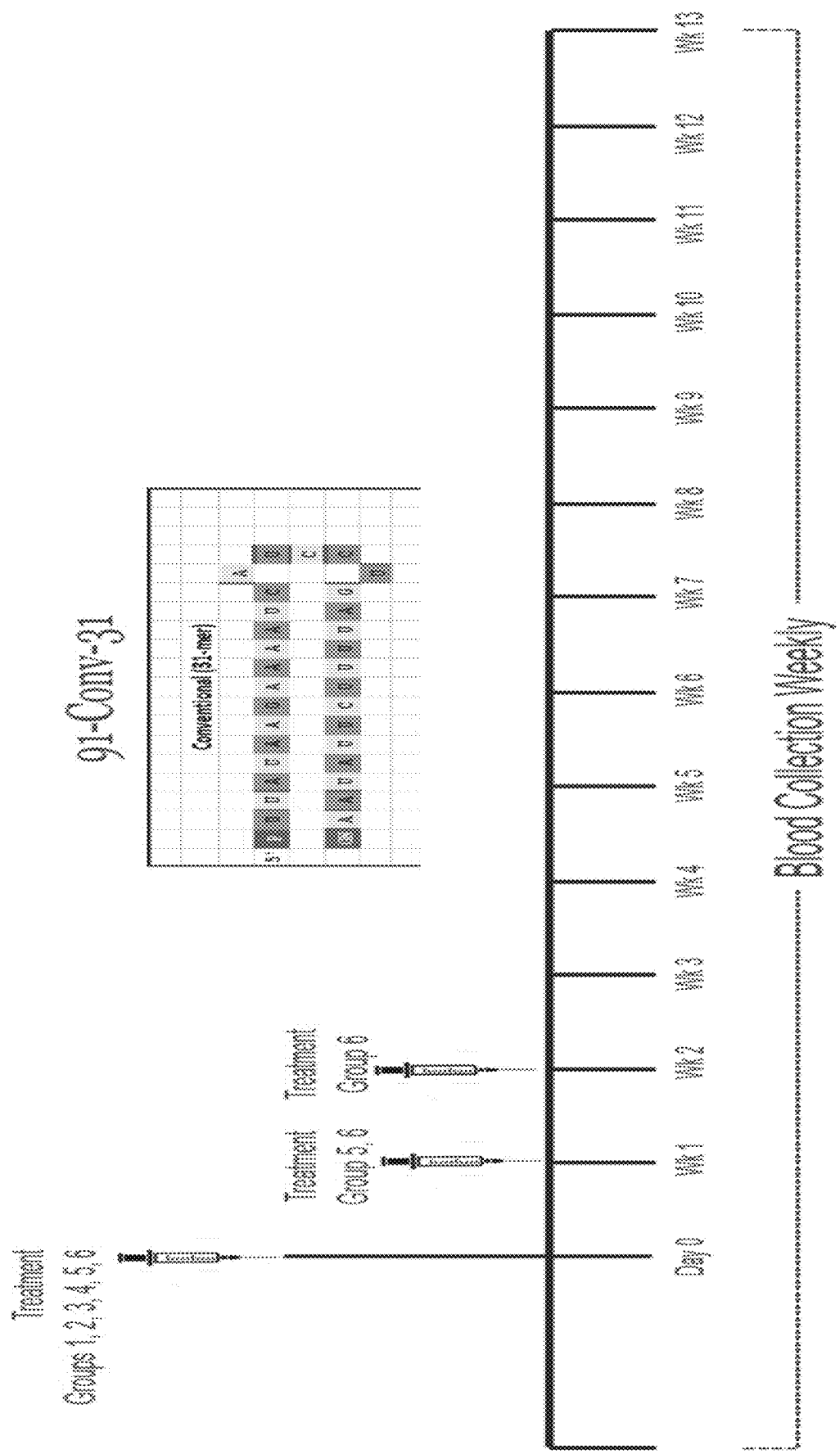
FIG. 24 shows the design of an in vivo study with compound 91-Conv-31: SEQ ID NO: 2366; see also Table 7, SEQ ID Nos. 2290 and 2288.
Figure 25:
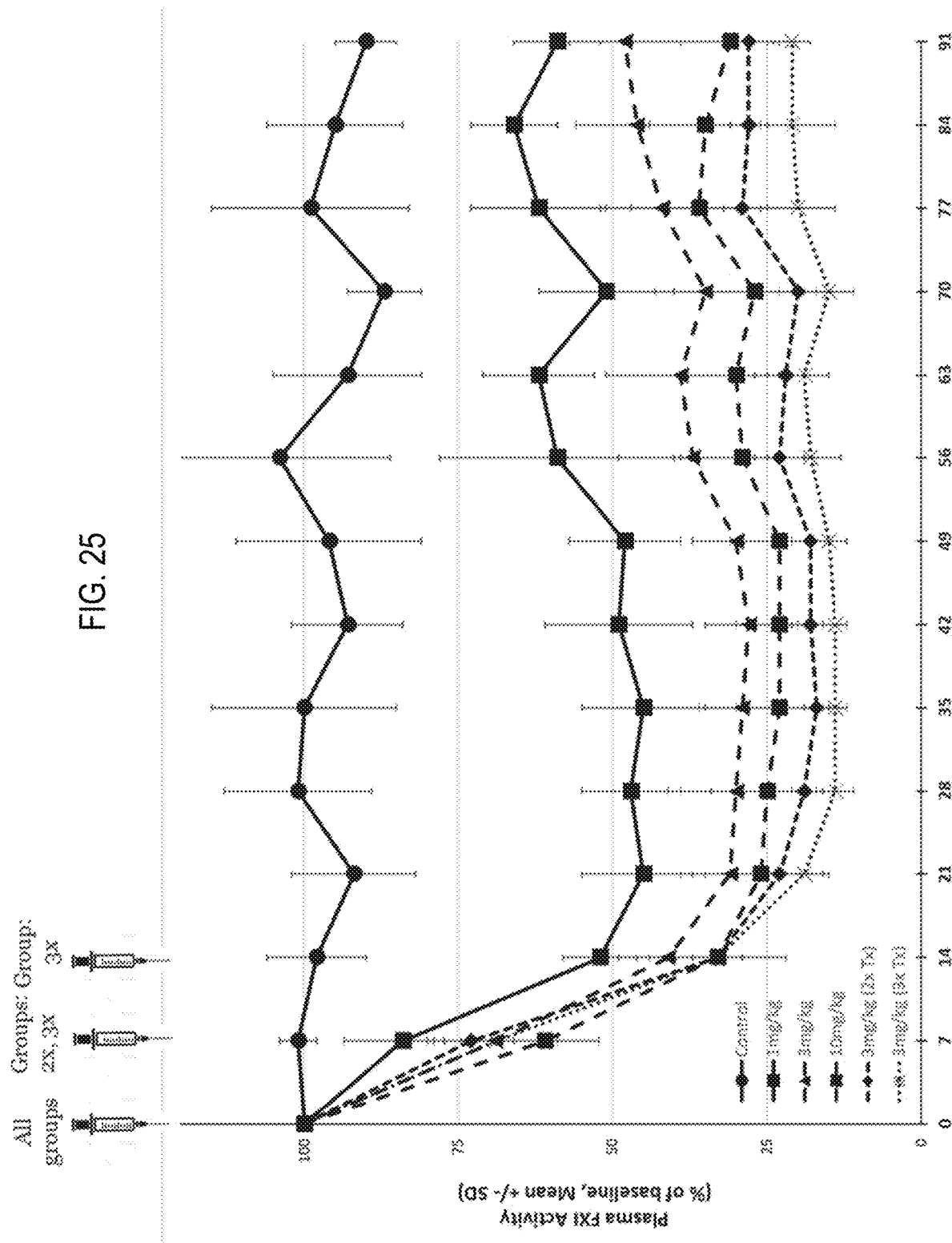
FIG. 25 shows performance of a compound in an in vivo study in terms of Factor XI activity knock-down.

The molecules disclosed herein, including, but not limited to, the hairpin RNAs as shown in Tables 6 and 7 and FIGS. 15 to 18, 20 and 22 are characterized by surprisingly outstanding performance, including in an in vivo setting; see, for example, the evidence shown in FIGS. 24 and 25. These data show a long-lasting down-regulation of Factor XI in response to administration of constructs as described herein. Further evidence of surprising performance of a plurality of constructs can be seen in the in vitro data provided in the Examples, including the data shown in FIG. 19.

The Figures as provided herein illustrate exemplary methods and data. While the methods are shown and described as being a series of acts that are performed in a particular sequence, it is to be understood and appreciated that the methods are not limited by the order of the sequence. For example, some acts can occur in a different order than what is described herein. In addition, an act can occur concurrently with another act. Further, in some instances, not all acts may be required to implement a method described herein.

The order of the steps of the methods described herein is exemplary, but the steps may be carried out in any suitable order, or simultaneously where appropriate. Additionally, steps may be added or substituted in, or individual steps may be deleted from any of the methods without departing from the scope of the subject matter described herein. Aspects of any of the Examples described above may be combined with aspects of any of the other Examples described to form further Examples.

It will be understood that the above description of a preferred embodiment is given by way of example only and that various modifications may be made by those skilled in the art. What has been described above includes Examples of one or more embodiments. It is, of course, not possible to describe every conceivable modification and alteration of the above compounds, compositions or methods for purposes of describing the aforementioned aspects, but one of ordinary skill in the art can recognize that many further modifications and permutations of various aspects are possible. Accordingly, the described aspects are intended to embrace all such alterations, modifications, and variations that fall within the scope of the appended claims.

EXAMPLES

The following Examples illustrate certain embodiments of the present disclosure and are not limiting. Moreover, where specific embodiments are provided, the inventors have contemplated generic application of those specific embodiments. For example, disclosure of an oligonucleotide having a particular motif or modification patterns provides reasonable support for additional oligonucleotides having the same or similar motif or modification patterns.

The syntheses of the RNAi constructs disclosed herein may be carried out using synthesis methods known to the person skilled in the art, such as synthesis methods disclosed in en.wikipedia.org/wiki/Oligonucleotide_synthesis {retrieved on 16 Feb. 2022}, wherein the methods disclosed on this website are incorporated by reference herein in their entirety. The only difference to the synthesis method disclosed in this reference is that GalNAc phosphoramidite immobilized on a support is used in the synthesis method during the first synthesis step.

The terms "construct number" and "SEQ ID NO" are used equivalently herein, especially with respect to 67 nucleobase sequences. Nucleobase sequences generally do not carry information about modifications of the sugar-phosphate backbone.

Example 1

Oligomeric compounds were synthesized using the oligonucleotides as set out in Tables 1a and 1b below.

TABLE 1a

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-01 | 1 | UCAAAAUCUUAGGUGACUC | 251 | CACCUAAGAUUUUGA |
| F11-02 | 2 | UAUUGAUUUAAAAUGCCAC | 252 | CAUUUUAAAUCAAUA |
| F11-03 | 3 | UAGAAAUCGCUGCUGUCCU | 253 | CAGCAGCGAUUUCUA |

TABLE 1a-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-04 | 4 | UAUAAGAAAAUCAUCCUGA | 254 | GAUGAUUUCUUAUA |
| F11-05 | 5 | UAAACACCGUAUUAGGGAA | 255 | CUAAUACGGUGUUUA |
| F11-06 | 6 | UAAAUCAGUGUCAUGGUAA | 256 | CAUGACACUGAUUUA |
| F11-07 | 7 | UAUACCCGCUUUCUGCCAU | 257 | CAGAAAGCGGGUAUA |
| F11-08 | 8 | UAGAUGUUUUAAGGAGACA | 258 | UCCUUAAAACAUCUA |
| F11-09 | 9 | UGGUAUCUUGGCUUUCUGG | 259 | AAAGCCAAGAUACCA |
| F11-10 | 10 | UCUCUGUAUCUCUUCUGGC | 260 | GAAGAGAUACAGAGA |
| F11-11 | 11 | UAUGGAUUAUUAUUUCUUG | 261 | AAAUAAUAAUCCAUA |
| F11-12 | 12 | UAGCCAGAUUAGAAAGUGC | 262 | UUUCUAAUCUGGCUA |
| F11-13 | 13 | UAGCGGACGGCAUUGGUGC | 263 | CAAUGCCGUCCGCUA |
| F11-14 | 14 | UAUUUCAGAUUGAUUUAAA | 264 | AAUCAAUCUGAAAUA |
| F11-15 | 15 | UUUGUCUCUUAGUUUUCUG | 265 | AAACUAAGAGACAAA |
| F11-16 | 16 | UAGAACACUGGGAUGCUGU | 266 | CAUCCCAGUGUUCUA |
| F11-17 | 17 | UCCACUUGAUAUAAGAAAA | 267 | CUUAUAUCAAGUGGA |
| F11-18 | 18 | UCAUUUUCUUACAAACACC | 268 | UUUGUAAGAAAAUGA |
| F11-19 | 19 | UUAAUGCGUGUACUGGGCA | 269 | CAGUACACGCAUUAA |
| F11-20 | 20 | UAGGACAGAGGGCCUCCCG | 270 | AGGCCCUCUGUCCUA |
| F11-21 | 21 | UCAACCGGGAUGAUGAGUG | 271 | CAUCAUCCCGGUUGA |
| F11-22 | 22 | UGACAAAGAUUUCUUUGAG | 272 | AAGAAAUCUUUGUCA |
| F11-23 | 23 | UGAGGAAGCAUGCUGGCAC | 273 | CAGCAUGCUUCCUCA |
| F11-24 | 24 | UGGAAAAUGUCCCUAAUAC | 274 | UAGGGACAUUUUCCA |
| F11-25 | 25 | UUUAAGUAACACUUGCCCU | 275 | CAAGUGUUACUUAAA |
| F11-26 | 26 | UCAAUAUCAUACCCGCUUU | 276 | CGGGUAUGAUAUUGA |
| F11-27 | 27 | UAAAUGUACCACUUGAUAU | 277 | CAAGUGGUACAUUUA |
| F11-28 | 28 | UAGAAAAUCAUCCUGAAAA | 278 | CAGGAUGAUUUUCUA |

TABLE 1a-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-29 | 29 | UUAACACUUGCCCUUCCCU | 279 | AAGGGCAAGUGUUAA |
| F11-30 | 30 | UAGCAUUUCUUACAAACA | 280 | UGUAAGAAAAUGCUA |
| F11-31 | 31 | UCAAACACCGUAUUAGGGA | 281 | UAAUACGGUGUUUGA |
| F11-32 | 32 | UAGCGGCUGUUAAUAUCCA | 282 | UAUUAACAGCCGCUA |
| F11-33 | 33 | UGAGCGGCUGUUAAUAUCC | 283 | AUUAACAGCCGCUCA |
| F11-34 | 34 | UGAGACAAAGAUUUCUUUG | 284 | GAAAUCUUUGUCUCA |
| F11-35 | 35 | UUGGGUUAUUUUAUGUCCU | 285 | CAUAAAAUAACCCAA |
| F11-36 | 36 | UGAGCCAUGACACUGUCGA | 286 | CAGUGUCAUGGCUCA |
| F11-37 | 37 | UCAGAUUAGAAAGUGCACA | 287 | CACUUUCUAAUCUGA |
| F11-38 | 38 | UAGAAUACCCAGAAAUCGC | 288 | UUUCUGGGUAUUCUA |
| F11-39 | 39 | UCAGAUGUUUUAAGGAGAC | 289 | CCUUAAAACAUCUGA |
| F11-40 | 40 | UUGUAUCCAGAGAUGCCUC | 290 | CAUCUCUGGAUACAA |
| F11-41 | 41 | UGAGUCACACAUUCACCAG | 291 | UGAAUGUGUGACUCA |
| F11-42 | 42 | UCAAAGAAAGAUGUGUCCU | 292 | CACAUCUUUCUUUGA |
| F11-43 | 43 | UACCACUUGAUAUAAGAAA | 293 | UUAUAUCAAGUGGUA |
| F11-44 | 44 | UAAGAAAGCUUUAAGUAAC | 294 | CUUAAAGCUUUCUUA |
| F11-45 | 45 | UUUAUUUCAGAUUGAUUUA | 295 | UCAAUCUGAAAUAAA |
| F11-46 | 46 | UUGGUGUGAGCAUUGCUUG | 296 | CAAUGCUCACACCAA |
| F11-47 | 47 | UAUCAUCCUGAAAAGACCU | 297 | CUUUUCAGGAUGAUA |
| F11-48 | 48 | UGUGAGCAUUGCUUGAAAG | 298 | CAAGCAAUGCUCACA |
| F11-49 | 49 | UCUGUAUCUCUUCUGGCAC | 299 | CAGAAGAGAUACAGA |
| F11-50 | 50 | UACCUUAAUGUGUAUCCAG | 300 | AUACACAUUAAGGUA |
| F11-51 | 51 | UAUCAUGGAUUAUUAUUUC | 301 | UAAUAAUCCAUGAUA |
| F11-52 | 52 | UCAAAGAUUUCUUUGAGAU | 302 | CAAAGAAAUCUUUGA |

TABLE 1a-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-53 | 53 | UGAAGUAUUUAGUUGGAG | 303 | AACUAAAUACUUCA |
| F11-54 | 54 | UAGAUUGAUUUAAAAUGCC | 304 | UUUUAAAUCAAUCUA |
| F11-55 | 55 | UGGGUAUCUUGGCUUUCUG | 305 | AAGCCAAGAUACCCA |
| F11-56 | 56 | UAGGAGACAAAGAUUUCUU | 306 | AAUCUUUGUCUCCUA |
| F11-57 | 57 | UGUCAUGGUAAAAUGAAGA | 307 | CAUUUUACCAUGACA |
| F11-58 | 58 | UAUAUCCAGUUCUUCUCCC | 308 | GAAGAACUGGAUAUA |
| F11-59 | 59 | UAAUAUCCAGUUCUUCUCC | 309 | AAGAACUGGAUAUUA |
| F11-60 | 60 | UCUGUGGUUUCCAGUUUCA | 310 | ACUGGAAACCACAGA |
| F11-61 | 61 | UAGAUUAGAAAGUGCACAG | 311 | GCACUUUCUAAUCUA |
| F11-62 | 62 | UAGAAAUCAGUGUCAUGGU | 312 | UGACACUGAUUUCUA |
| F11-63 | 63 | UUGGAUUAUUAUUUCUUGA | 313 | GAAAUAAUAAUCCAA |
| F11-64 | 64 | UCCAGAUUAGAAAGUGCAC | 314 | ACUUUCUAAUCUGGA |
| F11-65 | 65 | UCUCAUUAUCCAUUUUACA | 315 | AAAUGGAUAAUGAGA |
| F11-66 | 66 | UUUGGGCCAUUCCUGGGAA | 316 | CAGGAAUGGCCCAAA |
| F11-67 | 67 | UUGGGCUUGAUUUUGGUGG | 317 | CAAAAUCAAGCCCAA |
| F11-68 | 68 | UCAGAUUGAUUUAAAAUGC | 318 | UUUAAAUCAAUCUGA |
| F11-69 | 69 | UAAGCAACCGGGAUGAUGA | 319 | CAUCCCGGUUGCUUA |
| F11-70 | 70 | UCUUAAUGUGUAUCCAGAG | 320 | GGAUACACAUUAAGA |
| F11-71 | 71 | UGUAAUUCACUGUGGUUUC | 321 | CCACAGUGAAUUACA |
| F11-72 | 72 | UACAUUUCUAUCUCCUUUG | 322 | GGAGAUAGAAAUGUA |
| F11-73 | 73 | UCACUGGUUUCCAAUGAUG | 323 | AUUGGAAACCAGUGA |
| F11-74 | 74 | UGAAUCUGUGUAAUUCACU | 324 | AAUUACACAGAUUCA |
| F11-75 | 75 | UGUCCUAUUCACUCUUGGC | 325 | AGAGUGAAUAGGACA |
| F11-76 | 76 | UAGCAUUGCUUGAAAGAAU | 326 | UUUCAAGCAAUGCUA |
| F11-77 | 77 | UAAUACCCAGAAAUCGCUG | 327 | GAUUUCUGGGUAUUA |

TABLE 1a-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-78 | 78 | UAUUAUUAUUUCUUGAACC | 328 | CAAGAAAUAAUAAUA |
| F11-79 | 79 | UAAGUAUUUUAGUUGGAGA | 329 | CAACUAAAAUACUUA |
| F11-80 | 80 | UGAAUCCAGUCCACGUACU | 330 | CGUGGACUGGAUUCA |
| F11-81 | 81 | UAGACAAAGAUUUCUUUGA | 331 | AGAAAUCUUUGUCUA |
| F11-82 | 82 | UACAGGAUUUCAGUGAAAA | 332 | CACUGAAAUCCUGUA |
| F11-83 | 83 | UAACAAGGCAAUAUCAUAC | 333 | GAUAUUGCCUUGUUA |
| F11-84 | 84 | UAAGGCAAUAUCAUACCCG | 334 | UAUGAUAUUGCCUUA |
| F11-85 | 85 | UAUACCCAGAAAUCGCUGC | 335 | CGAUUUCGGGUAUA |
| F11-86 | 86 | UGAUUGAUUUAAAAUGCCA | 336 | AUUUUAAAUCAAUCA |
| F11-87 | 87 | UCCUAUUCACUCUUGGCAG | 337 | CAAGAGUGAAUAGGA |
| F11-88 | 88 | UGUAGACACGCAAAAUCUU | 338 | UUUUGCGUGUCUACA |
| F11-89 | 89 | UUGAGUUUUCUCCAGAAUC | 339 | CUGGAGAAAACUCAA |
| F11-90 | 90 | UAUUUCUUUGAGAUUCUUU | 340 | AAUCUCAAAGAAAUA |
| F11-91 | 91 | UUAUAAGAAAAUCAUCCUG | 341 | AUGAUUUUCUUAUAA |
| F11-92 | 92 | UAAAAUCUUAGGUGACUCU | 342 | UCACCUAAGAUUUUA |
| F11-93 | 93 | UACACUGGGAUGCUGUGCC | 343 | CAGCAUCCCAGUGUA |
| F11-94 | 94 | UUGCACAGGAUUUCAGUGA | 344 | UGAAAUCCUGUGCAA |
| F11-95 | 95 | UAUACAAGCCAGAUUAGAA | 345 | AAUCUGGCUUGUAUA |
| F11-96 | 96 | UUGUGGUUUCCAGUUUCAA | 346 | AACUGGAAACCACAA |
| F11-97 | 97 | UUGCCCUUCCCUUCGUUGC | 347 | CGAAGGGAAGGGCAA |
| F11-98 | 98 | UAAAAUCAUCCUGAAAAGA | 348 | UUCAGGAUGAUUUUA |
| F11-99 | 99 | UCCAAGAAAUCAGUGUCAU | 349 | CACUGAUUUCUUGGA |
| F11-100 | 100 | UGGCAUAUGGGUCGUUGAG | 350 | ACGACCCAUAUGCCA |
| F11-101 | 101 | UAGAAUCUGUGUAAUUCAC | 351 | AUUACACAGAUUCUA |

TABLE 1a-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-102 | 102 | UAUCCAGUCCACGUACUCG | 352 | UACGUGGACUGGAUA |
| F11-103 | 103 | UCCUCUGUAUCUCUUCUGG | 353 | AAGAGAUACAGAGGA |
| F11-104 | 104 | UGCACAGGAUUUCAGUGAA | 354 | CUGAAAUCCUGUGCA |
| F11-105 | 105 | UGUAAAAUGAAGAAUGGCA | 355 | AUUCUUCAUUUUACA |
| F11-106 | 106 | UGUCGUUGAGAAUCUGUGU | 356 | AGAUUCUCAACGACA |
| F11-107 | 107 | UGCAACAAUAUCCAGUUCU | 357 | CUGGAUAUUGUUGCA |
| F11-108 | 108 | UCAGCGGACGGCAUUGGUG | 358 | AAUGCCGUCCGCUGA |
| F11-109 | 109 | UGAAAGCUUUAAGUAACAC | 359 | UACUUAAAGCUUUCA |
| F11-110 | 110 | UGCAGUGUUUCUGUAACAC | 360 | UACAGAAACACUGCA |
| F11-111 | 111 | UGAGAAUCUGUGUAAUUCA | 361 | UUACACAGAUUCUCA |
| F11-112 | 112 | UUCCAGUCCACGUACUCGA | 362 | GUACGUGGACUGGAA |
| F11-113 | 113 | UUGUGAGCAUUGCUUGAAA | 363 | AAGCAAUGCUCACAA |
| F11-114 | 114 | UCCGGGAUGAUGAGUGCAG | 364 | ACUCAUCAUCCCGGA |
| F11-115 | 115 | UCCACUUUAUCGAGCUUCG | 365 | GCUCGAUAAAGUGGA |
| F11-116 | 116 | UCAUUAUCCAUUUUACACA | 366 | UAAAAUGGAUAAUGA |
| F11-117 | 117 | UAACCGGGAUGAUGAGUGC | 367 | UCAUCAUCCCGGUUA |
| F11-118 | 118 | UUUCUUUGGGCCAUUCCUG | 368 | AAUGGCCCAAAGAAA |
| F11-119 | 119 | UCUAAGGGUAUCUUGGCUU | 369 | CAAGAUACCCUUAGA |
| F11-120 | 120 | UUUGGUGUGAGCAUUGCUU | 370 | AAUGCUCACACCAAA |
| F11-121 | 121 | UCAUAUGGGUCGUUGAGAA | 371 | CAACGACCCAUAUGA |
| F11-122 | 122 | UUUAAUGUGUAUCCAGAGA | 372 | UGGAUACACAUUAAA |
| F11-123 | 123 | UUCAGAUGUUUUAAGGAGA | 373 | CUUAAAACAUCUGAA |
| F11-124 | 124 | UUUCCAAUGAUGGAGCCUC | 374 | CUCCAUCAUUGGAAA |
| F11-125 | 125 | UAGAAUCCAGUCCACGUAC | 375 | GUGGACUGGAUUCUA |
| F11-126 | 126 | UUUUGAGAUUCUUUGGGCC | 376 | CAAAGAAUCUCAAAA |

TABLE 1a-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-127 | 127 | UAAUCAUCCUGAAAAGACC | 377 | UUUUCAGGAUGAUUA |
| F11-128 | 128 | UAGACACGCAAAAUCUUAG | 378 | GAUUUUGCGUGUCUA |
| F11-129 | 129 | UCGUACUCGACCACGUUGG | 379 | CGUGGUCGAGUACGA |
| F11-130 | 130 | UCAUCCAGUCACCCAGCAA | 380 | UGGGUGACUGGAUGA |
| F11-131 | 131 | UAACACUGGGAUGCUGUGC | 381 | AGCAUCCCAGUGUUA |
| F11-132 | 132 | UCAGAAAGAGCUUUGCUCU | 382 | CAAAGCUCUUUCUGA |
| F11-133 | 133 | UUUCUUUGAGAUUCUUUGG | 383 | AGAAUCUCAAAGAAA |
| F11-134 | 134 | UAGCAACAAUAUCCAGUUC | 384 | UGGAUAUUGUUGCUA |
| F11-135 | 135 | UACCACUUUAUCGAGCUUC | 385 | CUCGAUAAAGUGGUA |
| F11-136 | 136 | UCCCUUCCCUUCGUUGCAG | 386 | AACGAAGGGAAGGGA |
| F11-137 | 137 | UCGCAAAAUCUUAGGUGAC | 387 | CCUAAGAUUUUGCGA |
| F11-138 | 138 | UAGCGUGUUACUGUGGAGG | 388 | CACAGUAACACGCUA |
| F11-139 | 139 | UCUCCUUCCCUGUAGCCGG | 389 | CUACAGGGAAGGAGA |
| F11-140 | 140 | UGUCCUCUGUAUCUCUUCU | 390 | GAGAUACAGAGGACA |
| F11-141 | 141 | UGUAUCUUGGCUUUCUGGA | 391 | GAAAGCCAAGAUACA |
| F11-142 | 142 | UCUCUUGGCAGUGUUUCUG | 392 | AACACUGCCAAGAGA |
| F11-143 | 143 | UGAAAUCAGUGUCAUGGUA | 393 | AUGACACUGAUUUCA |
| F11-144 | 144 | UCUUCCCUGUAGCCGGCAC | 394 | CGGCUACAGGGAAGA |
| F11-145 | 145 | UCUGGCCGCUCCCUUUGAG | 395 | AAGGGAGCGGCCAGA |
| F11-146 | 146 | UCACGCAAAAUCUUAGGUG | 396 | UAAGAUUUUGCGUGA |
| F11-147 | 147 | UGAAACCAGAAAGAGCUUU | 397 | CUCUUUCUGGUUUCA |
| F11-148 | 148 | UAAAGCUUUAAGUAACACU | 398 | UUACUUAAAGCUUUA |
| F11-149 | 149 | UACAAGCCAGAUUAGAAAG | 399 | CUAAUCUGGCUUGUA |
| F11-150 | 150 | UACUCAUUAUCCAUUUUAC | 400 | AAUGGAUAAUGAGUA |

TABLE 1a-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-151 | 151 | UCCUGAAAAGACCUUGUUG | 401 | AAGGUCUUUUCAGGA |
| F11-152 | 152 | UGGUUUCCAAUGAUGGAGC | 402 | CAUCAUUGGAAACCA |
| F11-153 | 153 | UCAGUUUCUGGCAGGCCUC | 403 | CCUGCCAGAAACUGA |
| F11-154 | 154 | UAUGGCAGAACACUGGGAU | 404 | CAGUGUUCUGCCAUA |
| F11-155 | 155 | UAGAUUUCUUUGAGAUUCU | 405 | UCUCAAAGAAAUCUA |
| F11-156 | 156 | UGUUUCCAGUUUCAACAAG | 406 | UUGAAACUGGAAACA |
| F11-157 | 157 | UUCCUCUGUAUCUCUUCUG | 407 | AGAGAUACAGAGGAA |
| F11-158 | 158 | UCAUCCUGAAAAGACCUUG | 408 | GUCUUUUCAGGAUGA |
| F11-159 | 159 | UUUGAGUUUUCUCCAGAAU | 409 | UGGAGAAAACUCAAA |
| F11-160 | 160 | UAAUUCACUGUGGUUUCCA | 410 | AACCACAGUGAAUUA |
| F11-161 | 161 | UAAGAUUUCUUUGAGAUUC | 411 | CUCAAAGAAAUCUUA |
| F11-162 | 162 | UGGAGACAAAGAUUUCUUU | 412 | AAAUCUUUGUCUCCA |
| F11-163 | 163 | UGAAAAUCAUCCUGAAAAG | 413 | UCAGGAUGAUUUUCA |
| F11-164 | 164 | UCUUUCUGCCAUUUUAUAC | 414 | AAAAUGGCAGAAAGA |
| F11-165 | 165 | UAGUCCACGUACUCGACCA | 415 | CGAGUACGUGGACUA |
| F11-166 | 166 | UUUAAUGCGUGUACUGGGC | 416 | AGUACACGCAUUAAA |
| F11-167 | 167 | UUAAUGUGUAUCCAGAGAU | 417 | CUGGAUACACAUUAA |
| F11-168 | 168 | UGAUUCUUUGGGCCAUUCC | 418 | UGGCCCAAAGAAUCA |
| F11-169 | 169 | UUGAAACCAGAAAGAGCUU | 419 | UCUUUCUGGUUUCAA |
| F11-170 | 170 | UCACACAUUCACCAGAAAC | 420 | CUGGUGAAUGUGUGA |
| F11-171 | 171 | UACAAAGAUUUCUUUGAGA | 421 | AAAGAAAUCUUUGUA |
| F11-172 | 172 | UCAUUUCUAUCUCCUUUGG | 422 | AGGAGAUAGAAAUGA |
| F11-173 | 173 | UUUUCUGUAACACUGUCUU | 423 | CAGUGUUACAGAAAA |
| F11-174 | 174 | UGGAUUUCAGUGAAAAUCC | 424 | UUUCACUGAAAUCCA |
| F11-175 | 175 | UCGCUCCCUUUGAGCACAG | 425 | GCUCAAAGGGAGCGA |

TABLE 1a-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-176 | 176 | UCAGUCCACGUACUCGACC | 426 | GAGUACGUGGACUGA |
| F11-177 | 177 | UAGGCAUAUGGGUCGUUGA | 427 | CGACCCAUAUGCCUA |
| F11-178 | 178 | UAUGUCCUCUGUAUCUCUU | 428 | GAUACAGAGGACAUA |
| F11-179 | 179 | UGCUUGAUUUUGGUGGUAC | 429 | CACCAAAAUCAAGCA |
| F11-180 | 180 | UAUGAUGGAGCCUCCACAC | 430 | GGAGGCUCCAUCAUA |
| F11-181 | 181 | UUCGUUGAGAAUCUGUGUA | 431 | CAGAUUCUCAACGAA |
| F11-182 | 182 | UUUAUCCAUUUUACACAAC | 432 | UGUAAAAUGGAUAAA |
| F11-183 | 183 | UUGUCCUAUUCACUCUUGG | 433 | GAGUGAAUAGGACAA |
| F11-184 | 184 | UCAAUAUCCAGUUCUUCUC | 434 | AGAACUGGAUAUUGA |
| F11-185 | 185 | UCUUUGAGAUUCUUUGGGC | 435 | AAAGAAUCUCAAAGA |
| F11-186 | 186 | UCACUCUUGGCAGUGUUUC | 436 | CACUGCCAAGAGUGA |
| F11-187 | 187 | UCUUGAAAGAAUACCCAGA | 437 | GGUAUUCUUUCAAGA |
| F11-188 | 188 | UAGGCAAUAUCAUACCCGC | 438 | GUAUGAUAUUGCCUA |
| F11-189 | 189 | UCUGUGUAAUUCACUGUGG | 439 | AGUGAAUUACACAGA |
| F11-190 | 190 | UAAUAUCCACUGGUUUCCA | 440 | AACCAGUGGAUAUUA |
| F11-191 | 191 | UUGAAAGAAUACCCAGAAA | 441 | UGGGUAUUCUUUCAA |
| F11-192 | 192 | UGUUAAUAUCCACUGGUUU | 442 | CAGUGGAUAUUAACA |
| F11-193 | 193 | UUGUCAUGGUAAAAUGAAG | 443 | AUUUUACCAUGACAA |
| F11-194 | 194 | UAUUCUUUGGGCCAUUCCU | 444 | AUGGCCCAAAGAAUA |
| F11-195 | 195 | UCAGUUCCUCCAACGAUCC | 445 | CGUUGGAGGAACUGA |
| F11-196 | 196 | UGGGUGUGCUUCAGUAGAC | 446 | ACUGAAGCACACCCA |
| F11-197 | 197 | UGAAGAAAGCUUUAAGUAA | 447 | UUAAAGCUUUCUUCA |
| F11-198 | 198 | UAUCCUGAAAAGACCUUGU | 448 | GGUCUUUUCAGGAUA |
| F11-199 | 199 | UAGAAAGCUUUAAGUAACA | 449 | ACUUAAAGCUUUCUA |

TABLE 1a-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-200 | 200 | UCAGUGUUUCUGUAACACU | 450 | UUACAGAAACACUGA |
| F11-201 | 201 | UGACACGCAAAAUCUUAGG | 451 | AGAUUUUGCGUGUCA |
| F11-202 | 202 | UGUGUGAGCAUUGCUUGAA | 452 | AGCAAUGCUCACACA |
| F11-203 | 203 | UACCAGAAAGAGCUUUGCU | 453 | AAGCUCUUUCUGGUA |
| F11-204 | 204 | UAGAAAGUGCACAGGAUUU | 454 | CCUGUGCACUUUCUA |
| F11-205 | 205 | UUUUAUUUCAGAUUGAUUU | 455 | CAAUCUGAAAUAAAA |
| F11-206 | 206 | UUAUCCAGUUCUUCUCCCA | 456 | AGAAGAACUGGAUAA |
| F11-207 | 207 | UCCGUGAAAGUGAAGAGUA | 457 | CUUCACUUUCACGGA |
| F11-208 | 208 | UGGUGUGCUUCAGUAGACA | 458 | UACUGAAGCACACCA |
| F11-209 | 209 | UGGACAGAGGGCCUCCCGA | 459 | GAGGCCCUCUGUCCA |
| F11-210 | 210 | UAAGAAAAUCAUCCUGAAA | 460 | AGGAUGAUUUUCUUA |
| F11-211 | 211 | UUGAGAUUCUUUGGGCCAU | 461 | CCCAAAGAAUCUCAA |
| F11-212 | 212 | UAUGUUUUAAGGAGACAAA | 462 | UCUCCUUAAAACAUA |
| F11-213 | 213 | UCACAGUUUCUGGCAGGCC | 463 | UGCCAGAAACUGUGA |
| F11-214 | 214 | UACAAUAUCCAGUUCUUCU | 464 | GAACUGGAUAUUGUA |
| F11-215 | 215 | UACAUUCACCAGAAACUGA | 465 | UUUCUGGUGAAUGUA |
| F11-216 | 216 | UCAAGGCAAUAUCAUACCC | 466 | AUGAUAUUGCCUUGA |
| F11-217 | 217 | UCUCCAACGAUCCUGGGCU | 467 | CAGGAUCGUUGGAGA |
| F11-218 | 218 | UCUGAAACCAGAAAGAGCU | 468 | CUUUCUGGUUUCAGA |
| F11-219 | 219 | UAAUCUCCCUUGCAAGCGU | 469 | UUGCAAGGGAGAUUA |
| F11-220 | 220 | UUGUGUAAUUCACUGUGGU | 470 | CAGUGAAUUACACAA |
| F11-221 | 221 | UUUUCAGUGAAAAUCCAGA | 471 | GAUUUUCACUGAAAA |
| F11-222 | 222 | UAAAUCAUCCUGAAAAGAC | 472 | UUUCAGGAUGAUUUA |
| F11-223 | 223 | UUACACUCAUUAUCCAUUU | 473 | GGAUAAUGAGUGUAA |
| F11-224 | 224 | UUUGGCAGUGUUUCUGUAA | 474 | AGAAACACUGCCAAA |

TABLE 1a-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-225 | 225 | UGGUACACUCAUUAUCCAU | 475 | AUAAUGAGUGUACCA |
| F11-226 | 226 | UAGGCAGGCAUAUGGGUCG | 476 | CCAUAUGCCUGCCUA |
| F11-227 | 227 | UCCAGUUUCAACAAGGCAA | 477 | CUUGUUGAAACUGGA |
| F11-228 | 228 | UUGGCCGCUCCCUUUGAGC | 478 | AAAGGGAGCGGCCAA |
| F11-229 | 229 | UACUGUGGUUUCCAGUUUC | 479 | CUGGAAACCACAGUA |
| F11-230 | 230 | UCUUUGGGCCAUUCCUGGG | 480 | GGAAUGGCCCAAAGA |
| F11-231 | 231 | UUAAGAAAAUCAUCCUGAA | 481 | GGAUGAUUUUCUUAA |
| F11-232 | 232 | UCUCUUUUAUUUCAGAUUG | 482 | CUGAAAUAAAAGAGA |
| F11-233 | 233 | UUCUUUGAGAUUCUUUGGG | 483 | AAGAAUCUCAAAGAA |
| F11-234 | 234 | UAAUGAUGGAGCCUCCACA | 484 | GAGGCUCCAUCAUUA |
| F11-235 | 235 | UGAAGAAUGGCAGAACACU | 485 | UUCUGCCAUUCUUCA |
| F11-236 | 236 | UCAAUGAUGGAGCCUCCAC | 486 | AGGCUCCAUCAUUGA |
| F11-237 | 237 | UAUGGAGCCUCCACACAGG | 487 | UGUGGAGGCUCCAUA |
| F11-238 | 238 | UCCCAAGAAAUCAGUGUCA | 488 | ACUGAUUUCUUGGGA |
| F11-239 | 239 | UGAGCCUCCACACAGGUGU | 489 | CUGUGUGGAGGCUCA |
| F11-240 | 240 | UCUCCCAAGAAAUCAGUGU | 490 | UGAUUUCUUGGGAGA |
| F11-241 | 241 | UCCUCCACACAGGUGUCUC | 491 | CACCUGUGUGGAGGA |
| F11-242 | 242 | UCCAAUGAUGGAGCCUCCA | 492 | GGCUCCAUCAUUGGA |
| F11-243 | 243 | UUUUCCAAUGAUGGAGCCU | 493 | UCCAUCAUUGGAAAA |
| F11-244 | 244 | UUCCCAAGAAAUCAGUGUC | 494 | CUGAUUUCUUGGGAA |
| F11-245 | 245 | UAGCCUCCACACAGGUGUC | 495 | CCUGUGUGGAGGCUA |
| F11-246 | 246 | UUCUUCUCCCAAGAAAUCA | 496 | UUCUUGGGAGAAGAA |
| F11-247 | 247 | UGUUUCCAAUGAUGGAGCC | 497 | CCAUCAUUGGAAACA |
| F11-248 | 248 | UUCCAAUGAUGGAGCCUCC | 498 | GCUCCAUCAUUGGAA |

TABLE 1a-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-249 | 249 | UUGGAGCCUCCACACAGGU | 499 | GUGUGGAGGCUCCAA |
| F11-250 | 250 | UGCCUCCACACAGGUGUCU | 500 | ACCUGUGUGGAGGCA |

In above Table 1a:
A represents adenine;
U represents uracil;
C represents cytosine;
G represents guanine.

TABLE 1b

Summary sequence table for active nucleobase sequences with chemical modifications:

| Oligo Name | construct No | Antisense (Guide) Strand Sequence (5' to 3') | construct No | Sense (Passenger) Strand Sequence (5' to 3') |
|---|---|---|---|---|
| F11-01M | 501 | PmU.fC.mA.fA.mA.fA.mU.fC.mU.fU.mA.fG.mG.fU.mG.fA.mC.fU.mC | 751 | fC.mA.fC.mC.fU.mA.fA.mG.fA.mU.fU.mU.fU.mG.fA |
| F11-02M | 502 | PmU.fA.mU.fU.mG.fA.mU.fU.mU.fA.mA.fA.mA.fU.mG.fC.mC.fA.mC | 752 | fC.mA.fU.mU.fU.mU.fA.mA.fA.mU.fC.mA.fA.mU.fA |
| F11-03M | 503 | PmU.fA.mG.fA.mA.fA.mU.fC.mG.fC.mU.fG.mC.fU.mG.fU.mC.fC.mU | 753 | fC.mA.fG.mC.fA.mG.fC.mG.fA.mU.fU.mU.fC.mU.fA |
| F11-04M | 504 | PmU.fA.mU.fA.mA.fG.mA.fA.mA.fA.mU.fC.mA.fU.mC.fC.mU.fG.mA | 754 | fG.mA.fU.mG.fA.mU.fU.mU.fU.mC.fU.mU.fA.mU.fA |
| F11-05M | 505 | PmU.fA.mA.fA.mC.fA.mC.fC.mC.fU.mA.fU.mU.fA.mG.fG.mA.fA.mA | 755 | fC.mU.fA.mA.fU.mA.fC.mC.fG.mU.fG.mU.fU.mU.fA |
| F11-06M | 506 | PmU.fA.mA.fA.mU.fC.mA.fG.mU.fG.mU.fC.mA.fU.mG.fG.mU.fA.mA | 756 | fC.mA.fU.mG.fA.mC.fA.mC.fU.mG.fA.mU.fU.mU.fA |
| F11-07M | 507 | PmU.fA.mU.fA.mC.fC.mC.fG.mC.fU.mU.fU.mC.fU.mG.fC.mC.fA.mU | 757 | fC.mA.fG.mA.fA.mA.fG.mC.fG.mG.fG.mU.fA.mU.fA |
| F11-08M | 508 | PmU.fA.mG.fA.mU.fG.mU.fU.mU.fU.mA.fA.mG.fG.mA.fG.mA.fC.mA | 758 | fU.mC.fC.mU.fU.mA.fA.mA.fA.mC.fA.mU.fC.mU.fA |
| F11-09M | 509 | PmU.fG.mG.fU.mA.fU.mC.fU.mU.fU.mG.fG.mC.fG.mU.fU.mC.fG.mG | 759 | fA.mA.fA.mC.fC.mC.fA.mA.fG.mA.fll.mA.fC.mC.fA |
| F11-10M | 510 | PmU.fC.mU.fC.mU.fG.mU.fA.mU.fC.mU.fC.mU.fU.mC.fU.mG.fG.mC | 760 | fG.mA.fA.mG.fA.mG.fA.mU.fA.mC.fA.mG.fA.mG.fA |
| F11-11M | 511 | PmU.fA.mU.fG.mG.fA.mU.fU.mA.fU.mU.fA.mU.fU.mU.fC.mU.fU.mG | 761 | fA.mA.fA.mU.fA.mA.fU.mA.fA.mU.fC.mC.fA.mU.fA |
| F11-12M | 512 | PmU.fA.mG.fC.mC.fA.mG.fA.mU.fU.mA.fG.mA.fA.mA.fG.mU.fG.mC | 762 | fU.mU.fU.mC.fU.mA.fA.mU.fC.mU.fG.mG.fC.mU.fA |
| F11-13M | 513 | PmU.fA.mG.fC.mG.fG.mA.fC.mG.fG.mC.fA.mU.fU.mG.fG.mU.fG.mC | 763 | fC.mA.fA.mU.fG.mC.fC.mG.fU.mC.fC.mG.fC.mU.fA |
| F11-14M | 514 | PmU.fA.mU.fU.mU.fC.mA.fG.mA.fU.mU.fG.mA.fU.mU.fU.mA.fA.mA | 764 | fA.mA.fU.mC.fA.mA.fU.mC.fU.mG.fA.mA.fA.mU.fA |
| F11-15M | 515 | PmU.fU.mU.fG.mU.fC.mU.fC.mU.fU.mG.fU.mU.fU.mC.fU.mG | 765 | fA.mA.fA.mC.fU.mA.fA.mG.fA.mG.fA.mC.fA.mA.fA |
| F11-16M | 516 | PmU.fA.mG.fA.mA.fC.mA.fC.mU.fU.mG.fG.mG.fA.mU.fG.mC.fU.mG.mU | 766 | fC.mA.fU.mC.fC.mC.fA.mG.fU.mG.fU.fU.mC.fU.mA |
| F11-17M | 517 | PmU.fC.mC.fA.mC.fU.mU.fG.mA.fU.mA.fU.mA.fA.mG.fA.mA.fA | 767 | fC.mU.fU.mA.fU.mA.fU.mC.fA.mA.fG.mU.fG.mG.fA |
| F11-18M | 518 | PmU.fC.mA.fU.mU.fU.mU.fC.mU.fU.mA.fC.mA.fA.mA.fC.mA.fC.mC | 768 | fU.mU.fU.mG.fU.mA.fA.mG.fA.mA.fA.mA.fU.mG.fA |
| F11-19M | 519 | PmU.fU.mA.fA.mU.fG.mC.fG.mU.fG.mU.fA.mC.fU.mG.mG.mC.mA | 769 | fC.mA.fG.mU.fA.mC.fA.mC.fG.mC.fA.mU.fU.mA.fA |
| F11-20M | 520 | PmU.fA.mG.fG.mA.fC.mA.fG.mA.fG.mG.fG.mC.fC.mU.fC.mC.fC.mG | 770 | fA.mG.fG.mC.fC.mC.fU.mC.fU.mG.fU.mC.fC.mU.fA |
| F11-21M | 521 | PmU.fC.mA.fA.mC.fC.mG.fG.mG.fA.mU.fG.mA.fU.mU.fG.mG | 771 | fC.mA.fU.mC.fA.mU.fC.mC.fC.mG.fG.mU.fU.mG.fA |
| F11-22M | 522 | PmU.fA.mA.fC.mA.fC.mA.fA.mU.fA.mU.fC.mU.fU.mU.fG.fA.mG | 772 | fA.mA.fG.mA.fA.mA.fU.mC.fU.mU.fU.mG.fU.mC.fA |
| F11-23M | 523 | PmU.fG.mA.fG.mG.fA.mA.fG.mC.fA.mU.fG.mC.fU.mG.fC.mC | 773 | fC.mA.fG.mC.fA.mU.fG.mC.fU.mC.fC.mU.fC.mC.fA |
| F11-24M | 524 | PmU.fG.mG.fA.mA.fA.mA.fU.mG.fU.mC.fC.mC.fU.mA.fA.mU.fA.mC | 774 | fU.mA.fG.mG.fG.mA.fC.mA.fU.mU.fU.mU.fC.mC.fA |
| F11-25M | 525 | PmU.fU.mU.fA.mA.fG.mU.fA.mA.fC.mA.fC.mU.fU.mG.fC.mC.fC.mU | 775 | fC.mA.fA.mG.fU.mG.fU.mU.fA.mC.fU.mU.fA.mA.fA |
| F11-26M | 526 | PmU.fC.mA.fA.mA.fU.mU.fC.mA.fU.mA.fC.mC.fC.mG.fC.mU.fU.mU | 776 | fC.mG.fG.mG.fU.mA.fU.mG.fA.mU.fA.mU.fU.mG.fA |

TABLE 1b-continued

Summary sequence table for active nucleobase sequences with chemical modifications:

| Oligo Name | construct No | Antisense (Guide) Strand Sequence (5' to 3') | construct No | Sense (Passenger) Strand Sequence (5' to 3') |
|---|---|---|---|---|
| F11-27M | 527 | PmU.fA.mA.fA.mU.fG.mU.fA.mC.fC.mA.fC.mU.fU.mG.fA.mU.fA.mU | 777 | fC.mA.fA.mG.fU.mG.fG.mU.fA.mC.fA.mU.fU.mU.fA |
| F11-28M | 528 | PmU.fA.mG.fA.mA.fA.mG.fA.mU.fG.mA.fU.mA | 778 | fC.mA.fG.mG.fA.mU.fG.mA.fU.mU.fU.mU.fC.mU.fA |
| F11-29M | 529 | PmU.fU.mA.fA.mC.fA.mC.fU.mU.fU.mG.mC.fC.mC.fU.mU.fC.mC.fC.mU | 779 | fA.mA.fG.mG.fG.mC.fA.mA.fG.mU.fG.mU.fU.mA.fA |
| F11-30M | 530 | PmU.fA.mG.fC.mA.fU.mU.fU.mU.fC.mU.mU.mA.fC.mA.fA.mA.fC.mA | 780 | fU.mG.fU.mA.fA.mG.fA.mA.fA.mA.fU.mG.fC.mU.fA |
| F11-31M | 531 | PmU.fC.mA.fA.mA.fC.mA.fC.mC.fG.mU.fA.mU.fU.mA.fG.mG.fG.mA | 781 | fU.mA.fA.mU.fA.mC.fG.mG.fU.mG.fU.mU.fU.mG.fA |
| F11-32M | 532 | PmU.fA.mG.fC.mG.fG.mC.fU.mG.fU.mU.fA.mA.fU.mA.fU.mC.fC.mA | 782 | fU.mA.fU.mU.fA.mA.fC.mA.fG.mC.fC.mG.fC.mU.fA |
| F11-33M | 533 | PmU.fG.mA.fG.mC.fG.mG.fC.mU.fG.mU.fU.mA.fA.mU.fA.mU.fC.mC | 783 | fA.mU.fU.mA.fA.mC.fA.mG.fC.mC.fG.mC.fU.mC.fA |
| F11-34M | 534 | PmU.fG.mA.fG.mA.fC.mA.fA.mA.fG.mA.fU .mU .fU .mC.fU .mU .fU .mG | 784 | fG.mA.fA.mA.fU. mC.fU. mU.fU.mG.fU.mC.fU.fA |
| F11-35M | 535 | PmU.fU.mG.fG.mG.fU.mU.fA.mU.fU.mU.mU.fU.mA.fU.mG.fU.mC.fC.mU | 785 | fC.mA.fU.mA.fA.mA.fA.mU.fA.mA.fC.mC.fC.mA.fA |
| F11-36M | 536 | PmU.fG.mA.fG.mC.fC.mA.fU.mG.fA.mC.fA.mC.fU.mC.fU.mC.fA | 786 | fC.mA.fG.mU.fG.mU.fC.mA.fU.mG.fG.mC.fU.mC.fA |
| F11-37M | 537 | PmU.fC.mA.fG.mA.fU.mU.fA.mG.fA.mA.fA.mG.fU.mG.fC.mA.fC.mA | 787 | fC.mA.fC.mU.fU.mU.fC.mU.fA.mA.fU.mC.fU.mG.fA |
| F11-38M | 538 | PmU.fA.mG.fA.mA.fU.mA.fC.mC.fC.mA.mG.fA.mA.fU.mU.fA | 788 | fU.mU.fU.mC.fU.mG.fG.mG.fU.mU.fC.mU.fA |
| F11-39M | 539 | PmU.fC.mA.fG.mA.fU.mG.fU.mU.fU.mU.mU.fA.mA.fG.mG.fA.mG.fA.mC | 789 | fC.mC.fU.mU.fA.mA.fA.mA.fC.mA.fU.mC.fU.mG.fA |
| F11-40M | 540 | PmU.fU.mG.fU.mA.fU.mC.f.mA.fG.mA.fU.mA.fC.mA.fC.mC.fU.mC | 790 | fC.mA.fU.mC.fU.mC.fU.mG.fG.mA.fU.mA.fC.mA.fA |
| F11-41M | 541 | PmU.fG.mA.fG.mU.fC.mA.fC.mA.fC.mA.fU.mU.fC.mA.fC.mC.fA.mG | 791 | fU.mG.fA.mA.fU.mG.fU.mG.fU.mG.fA.mC.fU.mC.fA |
| F11-42M | 542 | PmU.fC.mA.fA.mA.fG.mA.fA.mA.fG.mA.fU.mU.fC.mC.mU | 792 | fC.mA.fC.mA.fU. mC.fU. mU.fU.mC.fU.mU.fU.fA |
| F11-43M | 543 | PmU.fA.mC.fC.mA.fC.mU.fU.mG.fA.mU.fA.mU.fA.mA.fG.mA.fA.mA | 793 | fU.mU.fA.mU.fA.mU.fC.mA.fA.mG.fU.mG.fG.mU.fA |
| F11-44M | 544 | PmU.fA.mA.fG.mA.fA.mA.fG.mC.fU.mU.fU.mA.fA.mG.fU.mA.fA.mC | 794 | fC.mU.fU.mA.fA.mA.fG. mC.fU. m U.fU.mC.fU.mU.fA |
| F11-45M | 545 | PmU.fU.mU.fA.mU.fU.mU.fC.mA.fU.mU.fU.mA.fU.mU.fU.mA | 795 | fU.mC.fA.mA.fU.mC.fU.mU.fG.mA.fA.mU.fA.mA.fA |
| F11-46M | 546 | PmU.fU.mG.fG.mU.fG.mU.fG.mA.fG.mC.fA.mU.fU.mG.fC.mU.fU.mG | 796 | fC.mA.fA.mU.fG.mC.fU.mC.fA.mC.fA.mC.fC.mA.fA |
| F11-47M | 547 | PmU.fA.mU.fC.mA.fU.mC.fU.mU.fG.mA.fA.mA.fC.mA.fC.mU | 797 | fC.mU.fU.mU.fC.mA.fA.mG.fG.mA.fU.mG.fA.mU.fA |
| F11-48M | 548 | PmU.fG.mU.fG.mA.fG.mC.fA.mU.fU.mG.fC.mU.fU.mG.fA.mA.fA.mG | 798 | fC.mA.fA.mG.fC.mA.fA.mU.fG.mC.fU.mC.fA.mC.fA |
| F11-49M | 549 | PmU.fC.mU.fG.mU.fA.mU.fC.mU.fC.mU.mU.fC.mG.fG.mC.fA.mC | 799 | fC.mA.fG.mA.fA.fG.mA.mG.fA.mU.fA.mC.fA.mG.fA |
| F11-50M | 550 | PmU.fA.mC.fC.mU.fU.mA.fA.mU.fG.mU.fG.mU.fA.mU.fC.mC.fA.mG | 800 | fA.mU.fA.mC.fA.mC.fA.mU.fU.mA.fA.mG.fG.mU.fA |
| F11-51M | 551 | PmU.fA.mA.fU.mC.fA.mU.fU.mG.fG.mA.fU.mU.fU.mU.fA.mU.fU.mC | 801 | fU.mA.fA.mA.fA.mU.fA.mU.fC.mC.fA.mU.fU.mG.fA.mU.fA |
| F11-52M | 552 | PmU.fC.mA.fA.mA.fG.mA.fU.mU.fU.mC.fU.mU.fU.mG.fA.mG.fA.mU | 802 | fC.mA.fA.mA.fG.mA.fA.mA.fU.mC.fU.mU.fU.mG.fA |
| F11-53M | 553 | PmU.fG.mA.fA.mG.fU.mA.fU.mU.fU.mU.fA.mG.fU.mG.fA.mG | 803 | fA.mA.fC.mU.fA.mA.fA.mA.fU.mA.fC.mU.fU.mC.fA |
| F11-54M | 554 | PmU.fA.mG.fA.mU.fU.mG.fA.mU.fU.mU.fA.mA.fA.mA.fU.mG.fC.mC | 804 | fU.mU.fU.mU.fA.mA.fA.mU.fC.mA.fA.mU.fC.mU.fA |
| F11-55M | 555 | PmU.fG.mG.fG.mU.fA.mU.fC.mU.fU.mG.fC.mU.mU.mC.fU.mG | 805 | fA.mA.fG.mC.fC.mA.fA.mG.fA.mU.fA.mC.fC.mC.fA |
| F11-56M | 556 | PmU.fA.mG.fG.mA.fG.mA.fC.mA.fA.mA.fG.mA.fU.mU.fU.mC.fU.mU | 806 | fA.mA.fU.mC.fU.mU.fU.mG.fU.mC.fU.mC.fC.mU.fA |
| F11-57M | 557 | PmU.fG.mU.fC.mA.fU.mG.fG.mU.fA.mA.fA.mA.fU.mG.fA.mA.fG.mA | 807 | fC.mA.fU.mU.fU.mU.fA.mC.fC.mA.fU.mG.fA.mC.fA |
| F11-58M | 558 | PmU.fA.mU.fA.mU.fC.mA.fA.mG.fU.mU .fC. mU .fU .mC .fU. mC .fC .mC | 808 | fG.mA.fA.mG.fA.mA.fC.mU.fU.mG.fA.mU.fA.mU.fA |
| F11-59M | 559 | PmU.fA.mA.fU.mA.fU.mC.fC.mA.fG.mU.fU.mC.fU.mU.fC.mU.fC.mC | 809 | fA.mA.fG.mA.fA.mC.fU.mG.fG.mA.fU.mA.fU.mU.fA |
| F11-60M | 560 | PmU.fC.mU.fG.mU.fG.mG.fU.mU.fU.mC.fC.mA.fG.mU.fU.mC.fA | 810 | fA.mC.fU.mG.fG.mA.fA.mA.fC.mC.fA.mC.fA.mG.fA |
| F11-61M | 561 | PmU.fA.mG.fA.mU.fU.mA.fG.mA.fA.mA.fG.mU.fG.mC.fA.mC.fA.mG | 811 | fG.mC.fA.mC.fU.mU.fU.mC.fU.mA.fA.mU.fC.mU.fA |
| F11-62M | 562 | PmU.fA.mG.fA.mA.fA.mU.fC.mA.fG.mU.fG.mU.fC.mA.fU.mG.fG.mU | 812 | fU.mG.fA.mC.fA.mC.fU.mG.fA.mU.fU.mU.fC.mU.fA |
| F11-63M | 563 | PmU.fU.mG.fG.mA.fU.mU.fA.mU.fU.mA.fU.mU.fU.mC.fU.mU.fG.mA | 813 | fG.mA.fA.mA.fU.mA.fA.mU.fA.mA.fU.mC.fC.mA.fA |

TABLE 1b-continued

Summary sequence table for active nucleobase sequences with chemical modifications:

| Oligo Name | construct No | Antisense (Guide) Strand Sequence (5' to 3') | construct No | Sense (Passenger) Strand Sequence (5' to 3') |
|---|---|---|---|---|
| F11-64M | 564 | PmU.fC.mC.fA.mG.fA.mU.fU.mA.fG.mA.fA.mA.fG.mU.fG.mC.fA.mC | 814 | fA.mC.fU.mU.fU.mC.fU.mA.fA.mU.fC.mU.fG.mG.fA |
| F11-65M | 565 | PmU.fC.mU.fC.mA.fU.mU.fU.mC.fU.mC.mU.fU.mU.fU.mA.fC.mA | 815 | fA.mA.fA.mU.fG.mG.fA.mU.fA.mA.fU.mG.fA.mG.fA |
| F11-66M | 566 | PmU.fU.mU.fG.mG.fG.mC.fC.mA.fU.mU.fC.mC.fU.mG.fG.mG.fA.mA | 816 | fC.mA.fG.mG.fA.mA.fU.mG.fG.mC.fC.mC.fA.mA.fA |
| F11-67M | 567 | PmU.fU.mG.fG.mG.fC.mU.fU.mG.fA.mU.fU.mU.fU.mG.fG.mU.fG.mG | 817 | fC.mA.fA.mA.fA.mU.fC.mA.fA.mG.fC.mC.fC.mA.fA |
| F11-68M | 568 | PmU.fC.mA.fG.mA.fU.mU.fG.mA.fU.mU.fU.mA.fA.mA.fA.mU.fG.mC | 818 | fU.mU.fU.mA.fA.mA.fU.mC.fA.mA.fU.mC.fU.mG.fA |
| F11-69M | 569 | PmU.fA.mA.fG.mC.fA.mA.fC.mC.fG.mG.fG.mC.fU.mU.fA | 819 | fC.mA.fU.mC.fC.mC.fG.mG.fU.mU.fG.mC.fU.mU.fA |
| F11-70M | 570 | PmU.fC.mU.fU.mA.fA.mU.fG.mU.fG.mU.fA.mU.fC.mC.fA.mG.fA.mG | 820 | fG.mG.fA.mU.fA.mC.fA.mC.fA.mU.fU.mA.fA.mG.fA |
| F11-71M | 571 | PmU.fG.mU.fA.mA.fU.mU.fC.mA.fC.mU.fG.mU.fG.mG.fU.mU.fU.mC | 821 | fC.mC.fA.mC.fA.mG.fU.mG.fA.mA.fU.mU.fA.mC.fA |
| F11-72M | 572 | PmU.fA.mC.fA.mU.fU.mU.fC.mC.fU.mU.fU.mU.fU.mG | 822 | fG.mG.fA.mG.fA.mU.fA.mG.fA.mA.fA.mU.fG.mU.fA |
| F11-73M | 573 | PmU.fC.mA.fC.mU.fG.mG.fU.mU.fU.mC.fC.mA.fA.mU.fG.mG | 823 | fA.mU.fU.mG.fG.mA.fA.mA.fC.mC.fA.mG.fU.mG.fA |
| F11-74M | 574 | PmU.fG.mA.fA.mU.fC.mU.fG.mU.fG.mU.fA.mA.fU.mU.fC.mA.fC.mU | 824 | fA.mA.fU.mU.fA.mC.fA.mC.fA.mG.fA.mU.fU.mC.fA |
| F11-75M | 575 | PmU.fG.mU.fC.mC.fU.mA.fU.mU.fC.mA.fC.mU.fC.mU.fU.mG.mC | 825 | fA.mG.fA.mG.fU.mG.fA.mA.fU.mA.fG.mG.fA.mC.fA |
| F11-76M | 576 | PmU.fA.mG.fC.mA.fU.mU.fG.mC.fU.mU.fG.mA.fA.mA.fG.mA.fA.mil | 826 | fU.mU.fU.mC.fA.mA.fG.mC.fA.mA.fU.mG.fC.mU.fA |
| F11-77M | 577 | PmU.fA.mA.fU.mA.fC.mC.fC.mA.fG.mA.fA.mU.fG.mC.fU.mG | 827 | fG.mA.fU.mU.fU.mC.fU.mG.fG.mG.fU.mU.fA |
| F11-78M | 578 | PmU.fA.mU.fU.mA.fU.mU.fA.mU.fU.mU.fC.mll.fll.mG.fA.mA.fC.mC | 828 | fC.mA.fA.mG.fA.mA.fA.mil.fA.mA.fU.mA.fA.fU.fA |
| F11-79M | 579 | PmU.fA.mA.fG.mU.fA.mU.fU.mU.fU.mA.fG.mU.fU.mG.fG.mA.fG.mA | 829 | fC.mA.fA.mC.fU.mA.fA.mA.fA.mU.fA.mU.fU.fA |
| F11-80M | 580 | PmU.fG.mA.fA.mU.fC.mC.fA.mG.fU.mC.fC.mA.fC.mG.fU.mA.fC.mU | 830 | fC. mG .fU. mG .fG. mA.fC. mU .fG. mG.fA.mU.fU.mC.fA |
| F11-81M | 581 | PmU.fA.mG.fA.mC.fA.mA.fA.mG.fA.mU .fU .mil .fC .mil .fU .mil .fG .mA | 831 | fA.mG.fA.mA.fA.mU.fC.mU.fU.mU.fG.mU.fC.mU.fA |
| F11-82M | 582 | PmU.fA.mC.fA.mG.fG.mA.fU.mU.fU.mU.fU.mU.fU.mU.fU.mA | 832 | fC. mA.fC. mU.fG.mA.fA.mA.fU.mC.fC.mU.fG.mU.fA |
| F11-83M | 583 | PmU.fA.mA.fC.mA.fA.mG.fG.mC.fA.mA.fU.mA.fU.mC.fA.mU.fA.mC | 833 | fG.mA.fU.mA.fU.mU.fG.mC.fC.mU.fU.mG.fU.mU.fA |
| F11-84M | 584 | PmU.fA.mA.fG.mG.fC.mA.fA.mA.fU.mU.fC.mA.fU.mA.fC.mC.f.mG | 834 | fU.mA.fU.mA.fU.mU.fA.mU.fU.mG.fC.mC.fU.mU.fA |
| F11-85M | 585 | PmU.fA.mU.fA.mC.fC.mC.fA.mG.fA.mA.fA.mU.fC.mG.fC.mU.fG.mC | 835 | fC.mG.fA.mU.fU.mU.fC.mU.fG.mG.fG.mU.fA.mU.fA |
| F11-86M | 586 | PmU.fG.mA.fU.mU.fG.mA.fU.mU.fU.mA.fA.mA.fA.mU.fG.mC.fC.mA | 836 | fA.mU.fU.mU.fU.mA.fA.mA.fU.mC.fA.mA.fU.mC.fA |
| F11-87M | 587 | PmU.fC.mC.fU.mA.fU.mU.fC.mA.fC.mU.fC.mU.fU.mG.fG.mC.fA.mG | 837 | fC.mA.fA.mG.fA.mG.fU.mG.fA.mA.fU.mA.fG.mG.fA |
| F11-88M | 588 | PmU.fG.mU.fA.mG.fA.mC.fA.mC.fG.mC.fA.mA.fA.mA.fC.mU.fU | 838 | fU.mU.fU.mU.fG.mC.fG.mU.fG.mU.fC.mU.fA.mC.fA |
| F11-89M | 589 | PmU.fU.mG.fA.mG.fU.mU.fU.mU.fC.mU.fC.mC.fA.mG.fA.mA.fU.mC | 839 | fC.mU.fG.mG.fA.mG.fA.mA.fA.mA.fC.mU.fC.mA.fA |
| F11-90M | 590 | PmU.fA.mU.fU.mU.fC.mU.fU.mU.fU.mU.fG.mA.fG.mA.fU.mC.fU.mU | 840 | fA.mA.fG.mA.fU.mC.fA.mA.fA.mG.fA.mA.fA.mU.fA |
| F11-91M | 591 | PmU.fU.mA.fU.mA.fA.mG.fA.mA.fA.mA.fU.mC.fA.mU.fC.mC.fU.mG | 841 | fA.mU.fG.mA.fU.mU.fU.mU.fC.mU.fU.mA.fU.mA.fA |
| F11-92M | 592 | PmU.fA.mA.fA.mA.fU.mC.fU.mU.fA.mA.fG.mU.fG.mA.fU.mC.fU.mU | 842 | fU.mC.fA.mC.fC.mU.fA.mA.fG.mA.fU.mU.fU.mU.fA |
| F11-93M | 593 | PmU.fA.mC.fA.mC.fU.mG.fG.mG.fA.mA.fU.mG.fC.mC.fU.mG.fC.mC | 843 | fC.mA.fG.mC.fA.mU.fC.mC.fC.mA.fG.mU.fG.mU.fA |
| F11-94M | 594 | PmU.fU.mG.fC.mA.fC.mA.fG.mG.fA.mA.fU.mU.fC.mA.fG.mU.fG.mA | 844 | fU.mG.fA.mA.fU.mC.fC.mU.fG.fU.mG.fC.mA.fA |
| F11-95M | 595 | PmU.fA.mU.fA.mC.fA.mG.fA.mC.fC.mA.fG.mA.fU.mU.fA.mG.fA.mA | 845 | fA.mU.fA.mU.fC.fU.fG.mC.fU.mG.fU.mA.fU.fA |
| F11-96M | 596 | PmU.fU.mG.fU.mG.fG.mU.fU.mU.fC.mC.fA.mG.fU.mU.fU.mC.fA.mA | 846 | fA.mA.fC.mU.fG.mG.fA.mA.fA.mC.fC.mA.fC.mA.fA |
| F11-97M | 597 | PmU.fU.mG.fC.mC.fC.mU.fU.mC.fC.mC.fU.mU.fU.mU.fG.mC | 847 | fC.mG.fA.mA.fG.mG.fG.mA.fA.mG.fG.mG.fC.mA.fA |
| F11-98M | 598 | PmU.fA.mA.fA.mU.fA.mU.fA.mU.fC.mC.fU.mG.fA.mA.fA.mG.fA | 848 | fU.mU.fC.mA.fG.mG.fA.mU.fA.mU.fU.mU.fA |
| F11-99M | 599 | PmU.fC.mC.fA.mA.fG.mA.fA.mA.fU.mC.fA.mG.fU.mG.fU.mC.fA.mU | 849 | fC.mA.fC.mU.fG.mA.fU.mU.fU.mC.fU.mU.fG.mG.fA |
| F11-100M | 600 | PmU.fG.mG.fC.mA.fU.mA.fU.mG.fG.mG.fU.mC.fG.mU.fU.mG.fA.mG | 850 | fA.mC.fG.mA.fC.mC.fC.mA.fU.mA.fU.mG.fC.mC.fA |

TABLE 1b-continued

Summary sequence table for active nucleobase sequences with chemical modifications:

| Oligo Name | construct No | Antisense (Guide) Strand Sequence (5' to 3') | construct No | Sense (Passenger) Strand Sequence (5' to 3') |
|---|---|---|---|---|
| F11-101M | 601 | PmU.fA.mG.fA.mA.fU.mC.fU.mG.fU.mG.fU.mA.fA.mU.fU.mC.fA.mC | 851 | fA.mU.fU.mA.fC.mA.fC.mA.fG.mA.fU.mU.fC.mU.fA |
| F11-102M | 602 | PmU.fA.mU.fC.mC.fA.mG.fU.mC.fC.mA.fC.mG.fU.mA.fC.mU.fC.mG | 852 | fU.mA.fC.mG.fU.mG.fG.mA.fC.mU.fG.mG.fA.mU.fA |
| F11-103M | 603 | PmU.fC.mC.fU.mC.fU.mG.fU.mA.fU.mC.fU.mC.fU.mU.fC.mU.fG.mG | 853 | fA.mA.fG.mA.fG.mA.fU.mA.fC.mA.fG.mA.fG.mG.fA |
| F11-104M | 604 | PmU.fG.mC.fA.mC.fA.mG.fG.mA.fU.mU.fU.mC.fA.mG.fU.mG.fA.mA | 854 | fC.mU.fG.mA.fA.mA.fU.mC.fC.mU.fG.mU.fG.mC.fA |
| F11-105M | 605 | PmU.fG.mU.fA.mA.fA.mA.fU.mG.fA.mA.fG.mA.fA.mU.fG.mG.fC.mA | 855 | fA.mU.fU.mC.fU.mU.fC.mA.fU.mU.fU.mU.fA.mC.fA |
| F11-106M | 606 | PmU.fG.mU.fC.mG.fU.mU.fG.mA.fG.mA.fA.mU.fC.mU.fG.mU.fG.mU | 856 | fA.mG.fA.mU.fU.mC.fU.mC.fA.mA.fC.mG.fA.mC.fA |
| F11-107M | 607 | PmU.fG.mC.fA.mA.fC.mA.fA.mU.fA.mU.fC.mC.fA.mG.fU.mU.fC.mU | 857 | fC.mU.fG.mG.fA.mU.fA.mU.fU.mG.fU.mU.fG.mC.fA |
| F11-108M | 608 | PmU.fC.mA.fG.mC.fG.mG.fA.mC.fG.mC.mA.fU.mG.fA.mU.mG.fU.mG.fA | 858 | fA.mA.fU.mG.fC.mC.fG.mU.fC.mC.fG.mC.fU.mG.fA |
| F11-109M | 609 | PmU.fG.mA.fA.mA.fG.mC.fU.mU.fU.mA.fA.mG.fU.mA.fA.mC.fA.mC | 859 | fU.mA.fC.mU.fU.mA.fA.mA.fG.mC.fU.mU.fU.mC.fA |
| F11-110M | 610 | PmU.fG.mC.fA.mG.fU.mG.fU.mU.fU.mC.fU.mU.fA.mA.fA.mC | 860 | fU.mA.fC.mA.fG.mA.fA.mA.fC.mA.fC.mU.fG.mC.fA |
| F11-111M | 611 | PmU.fG.mA.fG.mA.fA.mU.fC.mU.fG.mU.fG.mU.fA.mA.fU.mU.fC.mA | 861 | fU.mU.fA.mC.fA.mC.fA.mG.fA.mU.fU.mC.fU.mC.fA |
| F11-112M | 612 | PmU.fU.mC.fC.mA.fG.mU.fC.mC.fA.mC.fU.mU.fA.mA.fU.mC.fG.mA | 862 | fG.mU.fA.mC.fG.mU.fG.mG.fA.mC.fU.mG.fG.mA |
| F11-113M | 613 | PmU.fU.mG.fU.mG.fA.mG.fC.mA.fU.mU.fG.mC.fU.mU.fG.mA.fA.mA | 863 | fA.mA.fG.mC.fA.mA.fU.mG.fC.mU.fC.mA.fC.mA.fA |
| F11-114M | 614 | PmU.fC.mC.fG.mG.fG.mA.fU.mG.fA.mU.fG.mA.fG.mU.fG.mC.fA.mG | 864 | fA.mC.fU.mC.fA.mU.fC.mA.fU.mC.fC.mC.fG.mG.fA |
| F11-115M | 615 | PmU.fC.mC.fA.mC.fU.mU.fU.mA.fU.mC.fG.mA.fG.mC.fU.mU.fC.mG | 865 | fG.mC.fU.mC.fG.mA.fU.mA.fA.mA.fG.mU.fG.mG.fA |
| F11-116M | 616 | PmU.fC.mA.fU.mU.fA.mU.fC.mC.fA.mU.fU.mU.fU.mA.fC.mA.fC | 866 | fU.mA.fA.mA.fA.mU.fG.mG.fA.miI.fA.mA.fU.mG.fA |
| F11-117M | 617 | PmU.fA.mA.fC.mC.fG.mG.fG.mA.fU.mG.fA.mU.fG.mA.fG.mU.fG.mC | 867 | fU.mC.fA.mA.fU.fC.mA.fU.mC.fC.mC.fG.mG.fU.mU.fA |
| F11-118M | 618 | PmU.fU.mU.fC.mU.fU.mU.fG.mG.fG.mC.fC.mA.fU.mU.fC.mC.fU.mG | 868 | fA.mA.fU.mG.fG.mC.fC.mC.fA.mA.fA.mG.fA.mA.fA |
| F11-119M | 619 | PmU.fC.mU.fA.mA.fG.mG.fG.mU.fA.mU.fC.mU.fU.mG.fG.mC.fU.mU | 869 | fC.mA.fA.mG.fA.mU.fA.mC.fC.mC.fU.mU.fA.mG.fA |
| F11-120M | 620 | PmU.fU.mU.fG.mG.fU.mG.fU.mG.fA.mG.fC.mA.fU.mU.fG.mC.fU.mU | 870 | fA.mA.fU.mG.fC.mU.fC.mA.fC.mA.fC.mC.fA.mA.fA |
| F11-121M | 621 | PmU.fC.mA.fU.mU.fU.mG.fG.mG.fU.mC.fG.mU.fU.mG.fA.mA | 871 | fC.mA.fA.mC.fG.mA.fC.mC.fC.mA.fU.mA.fU.mG.fA |
| F11-122M | 622 | PmU.fU.mU.fA.mA.fU.mG.fU.mG.fU.mA.fU.mC.fC.mA.fG.mA.fG.mA | 872 | fU.mG.fG.mA.fU.mA.fC.mA.fC.mA.fU.mU.fA.mA.fA |
| F11-123M | 623 | PmU.fU.mC.fA.mG.fA.mU.fG.mU.fU.mU.fU.mA.fA.mG.fG.mA | 873 | fC.mU.fU.mA.fA.mA.fA.mC.fA.mU.fC.mU.fG.mA.fA |
| F11-124M | 624 | PmU.fU.mC.fC.mA.fA.mU.fG.mA.fU.mG.fA.mG.fC.mC.fU.mC | 874 | fC.mU.fC.mC.fA.mU.fC.mA.fU.mU.fG.mG.fA.mA.fA |
| F11-125M | 625 | PmU.fA.mG.fA.mA.fU.mC.fC.mA.fG.mU.fC.mC.fA.mC.fG.mU.fA.mC | 875 | fG.mU.fG.mG.fA.mC.fU.mG.fG.mA.fU.mU.fC.mU.fA |
| F11-126M | 626 | PmU.fU.mU.fU.mG.fA.mG.fA.mU.fU.mU.fU.mG.fG.mG.fC.mC | 876 | fC.mA.fA.mA.fG.mA.fA.mU.fC.mU.fC.mA.fA.mA.fA |
| F11-127M | 627 | PmU.fA.mA.fU.mC.fA.mU.fC.mC.fU.mU.fG.mA.fA.mA.fG.mA.fC.mC | 877 | fU.mU.fU.mC.fA.mA.fG.mG.fA.mU.fG.mA.fU.mU.fA |
| F11-128M | 628 | PmU.fA.mG.fA.mC.fA.mC.fG.mC.fA.mU.fC.mU.fU.fA.mG | 878 | fG.mA.fU.mU.fU.mU.fG.mC.fG.mU.fG.mU.fC.mU.fA |
| F11-129M | 629 | PmU.fC.mG.fU.mA.fC.mU.fC.mG.fA.mC.fC.mG.fU.mG.fG | 879 | fC.mG.fU.mG.fG.mU.fC.mG.fA.mG.fU.mA.fC.mG.fA |
| F11-130M | 630 | PmU.fC.mA.fU.mC.fC.mA.fG.mU.fC.mA.fC.mC.fC.mA.fG.mC.fA.mA | 880 | fU.mG.fG.mG.fU.mG.fA.mC.fU.mG.fG.mA.fU.mG.fA |
| F11-131M | 631 | PmU.fA.mA.fC.mA.fC.mU.fG.mG.fG.mA.fU.mG.fC.mU.fG.mU.fG.mC | 881 | fA.mG.fC.mA.fU.mC.fC.mC.fA.mG.fU.mG.fU.mU.fA |
| F11-132M | 632 | PmU.fC.mA.fG.mA.fA.mG.fA.mG.fG.mA.fG.mC.fU.mU.fG.mC.fU.mU | 882 | fC.mA.fA.mG.fC.mU.fC.mC.fU.mU.fC.mU.fG.mA |
| F11-133M | 633 | PmU.fU.mU.fC.mU.fU.mU.fG.mA.fG.mA.fU.mU.fU.mU.fG.mG | 883 | fA.mG.fA.mA.fU.mC.fU.mC.fA.mA.fA.mG.fA.mA.fA |
| F11-134M | 634 | PmU.fA.mG.fC.mA.fA.mC.fA.mA.fU.mA.fU.mC.fC.mA.mU.fU.mC | 884 | fU.mG.fG.mA.fU.mA.fU.mU.fG.mU.fU.mG.fC.mU.fA |
| F11-135M | 635 | PmU.fA.mC.fC.mA.fC.mU.fU.mU.fA.mU.fC.mG.fA.mG.fC.mU.fU.fC | 885 | fC.mU.fC.mG.fA.mU.fA.mA.fA.mG.fU.mG.fG.mU.fA |
| F11-136M | 636 | PmU.fC.mC.fC.mU.fU.mC.fC.mC.fU.mU.fC.mG.fU.mU.fG.mC.fA.mG | 886 | fA.mA.fC.mG.fA.mA.fG.mG.fG.mA.fA.mG.fG.mG.fA |
| F11-137M | 637 | PmU.fC.mG.fC.mA.fA.mA.fA.mU.fC.mU.fU.mA.fG.mG.fU.mG.fA.mC | 887 | fC.mC.fU.mA.fA.mG.fA.mU.fU.mU.fU.mG.fC.mG.fA |

TABLE 1b-continued

Summary sequence table for active nucleobase sequences with chemical modifications:

| Oligo Name | construct No | Antisense (Guide) Strand Sequence (5' to 3') | construct No | Sense (Passenger) Strand Sequence (5' to 3') |
|---|---|---|---|---|
| F11-138M | 638 | PmU.fA.mG.fC.mG.fU.mG.fU.mU.fA.mC.fU.mG.fU.mG.fG.mA.fG.mG | 888 | fC.mA.fC.mA.fG.mU.fA.mA.fC.mA.fC.mG.fC.mU.fA |
| F11-139M | 639 | PmU.fC.mU.fC.mC.fU.mU.fC.mC.fC.mU.fG.mU.fA.mG.fC.mC.fG.mG | 889 | fC.mU.fA.mC.fA.mG.fG.mG.fA.mA.fG.mG.fA.mG.fA |
| F11-140M | 640 | PmU.fG.mU.fC.mC.fU.mC.fU.mG.fU.mA.fU.mC.fU.mC.fU.mU.fC.mU | 890 | fG.mA.fG.mA.fU.mA.fC.mA.fG.mA.fG.mG.fA.mG.fA |
| F11-141M | 641 | PmU.fG.mU.fA.mU.fC.mU.fU.mG.fG.mC .fU. mU. fU .mC .fU. mG .fG .mA | 891 | fG.mA.fA.mA.fG.mC.fC.mA.fA.mG.fA.mU.fA.mC.fA |
| F11-142M | 642 | PmU.fC.mU.fC.mU.fU.mG.fG.mC.fA.mG.fU.mG.fU.mU.fU.mC.fU.mG | 892 | fA.mA.fC.mA.fC.mU.fG.mC.fC.mA.fA.mG.fA.mG.fA |
| F11-143M | 643 | PmU.fG.mA.fA.mA.fU.mC.fA.mG.fU.mA.fU.mC.fA.mU.fG.mG.fU.mA | 893 | fA.mU.fG.mA.fC.mA.fC.mU.fG.mA.fU.mU.fU.mC.fA |
| F11-144M | 644 | PmU.fC.mU.fU.mC.fC.mC.fU.mG.fU.mA.fG.mC.fC.mG.fG.mC.fA.mC | 894 | fC.mG.fG.mC.fU.mA.fC.mA.fG.mG.fG.mA.fA.mG.fA |
| F11-145M | 645 | PmU.fC.mU.fG.mG.fC.mC.fG.mC.fU.mC.fC.mC.fU.mU.mG.fA.mG | 895 | fA.mA.fG.mG.fG.mA.fG.mC.fG.mG.fC.mC.fA.mG.fA |
| F11-146M | 646 | PmU.fC.mA.fC.mG.fC.mA.fA.mA.fA.mU.fC.mU.fU.mA.fG.mG.fU.mG | 896 | fU.mA.fA.mG.fA.mU.fU.mU.fU.mG.fC.mG.fU.mG.fA |
| F11-147M | 647 | PmU.fG.mA.fA.mA.fC.mC.fA.mG.fA.mA.fU.mA.fA.mA.fA.mC.fU.mU | 897 | fC.mU.fC.mU.fU.mU.fC.mU.fG.mG.fU.mU.fU.mC.fA |
| F11-148M | 648 | PmU.fA.mA.fA.mG.fC.mU.fU.mU.fA.mA.fG.mU.fA.mA.fC.mA.fC.mU | 898 | fU.mU.fA.mC.fU.mU.fA.mA.fA.mG.fC.mU.fU.mU.fA |
| F11-149M | 649 | PmU.fA.mC.fA.mA.fG.mC.fC.mA.fG.mA.fU.mA.mG.fA.mA.fA.mG | 899 | fC.mU.fA.mA.fU.mC.fU.mG.fG.mC.fU.mU.fG.mU.fA |
| F11-150M | 650 | PmU.fA.mC.fU.mC.fA.mU.fU.mA.fU.mU.fC.mA.fU.mU.fU.mU.fA.mC | 900 | fA.mA.fU.mG.fG. mA.fU. mA.fA.mU.fG.mA.fG.mU.fA |
| F11-151M | 651 | PmU.fC.mC.fU.mG.fA.mA.fA.mA.fG.mA.fC.mC.fU.mG.fU.mU.fG | 901 | fA.mA.fG.mG.fU.mC.fU.mU.fU.mU.fC.mA.fG.mG.fA |
| F11-152M | 652 | PmU.fG.mG.fU.mU.fU.mC.fC.mA.fA.mu .fG. mA.fU. mG .fG. mA .fG. mC | 902 | fC. mA.fU. mC.fA.mU.fU.mG.fG.mA.fA.mA.fC.mC.fA |
| F11-153M | 653 | PmU.fC.mA.fG.mU.fU.mU.fC.mU.fG.mG.fC.mA.fG.mG.fC.mC.fU.mC | 903 | fC.mC.fU.mG.fC.mC.fA.mG.fA.mA.fA.mC.fU.mG.fA |
| F11-154M | 654 | PmU.fA.mU.fG.mG.fA.mA.fG.mA.fA.mC.fA.mC.fU.mG.fG.mG.fA.mU | 904 | fC.mA.fG.mU.fG.mU.fU.mC.fU.mU.fC.mC.fA.mU.fA |
| F11-155M | 655 | PmU.fA.mG.fA.mU.fU.mU.fC.mU.fU.mU.fG.mA.fG.mA.fU.mU.fC.mU | 905 | fU.mC.fU.mC.fA.mA.fA.mG.fA.mA.fA.mU.fC.mU.fA |
| F11-156M | 656 | PmU.fG.mU.fU.mU.fC.mA.mG.fU.mU.fU.mC.fA.mA.fC.mA.fA.mG | 906 | fU.mU.fG.mA.fA.mA.fC.mU.fG.mG.fA.mA.fA.mC.fA |
| F11-157M | 657 | PmU.fU.mC.fC.mU.fC.mC.fU.mG.fU.mA.mU.fC.mU.fC.mU.fU.mC.fU.mG | 907 | fA.mG.fA.fG.mA.fU.mA.fC.mA.fG.mA.fG.fG.mA.fA |
| F11-158M | 658 | PmU.fC. mA.fU. mC.fC.mU.fG.mA.fA.mA.fA.mC.fC.mU.fU.mG | 908 | fG.mU.fC.mU.fU.mU.fC.mA.mG.fG.mA.fU.mG.fA |
| F11-159M | 659 | PmU.fU.mU.fG.mA.fG.mU.fU.mU.fU.mC.fU.mC.fC.mA.fG.mA.fA.mU | 909 | fU.mG.fG.mA.fG.mA.fA.mA.fA.mC.fU.mC.fA.mA.fA |
| F11-160M | 660 | PmU.fA.mA.fU.mU.fC.mA.fC.mU.fG.mG.fU.mU.fU.mC.fC.mA | 910 | fA.mA.fC.mC.fA.mC.fA.mG.fU.mG.fA.mA.fU.mU.fA |
| F11-161M | 661 | PmU.fA.mA.fG.mA.fU.mU.fU.mC.fU.mU.fU.mG.fA.mG.fA.mU.fU.mC | 911 | fC.mU.fC.mA.fA.mA.fG.mA.fA.mA.fU.mC.fU.mU.fA |
| F11-162M | 662 | PmU.fG.mG.fA.mG.fA.mA.fC.mA.fA.mA.fU.mU.fC.mU.fU.mU | 912 | fA.mA.fA.mU.fU.mU.fG.mU.fU.mC.fU.mC.fC.fA |
| F11-163M | 663 | PmU.fG.mA.fA.mA.fA.mU.fC.mA.fU.mC.fC.mU.fG.mA.fA.mA.fA.mG | 913 | fU.mC.fA.mG.fG.mA.fU.mG.fA.mU.fU.mU.fU.mC.fA |
| F11-164M | 664 | PmU.fC.mU.fU.mU.fC.mU.fG.mG.fC.mC.mA.fU.mU.fU.mU.fA.mU.fA.mC | 914 | fA.mA.fA.mA.fU.mG.fG.mC.fA.mG.fA.mA.fA.mG.fA |
| F11-165M | 665 | PmU.fA.mG.fU.mC.fC.mA.fC.mG.fU.mA.fC.mU.fC.mG.fA.mC.fC.mA | 915 | fC.mG.fA.mG.fU.mA.fC.mG.fU.mG.fG.mA.fC.mU.fA |
| F11-166M | 666 | PmU.fU.mU.fA.mA.fU.mG.fC.mG.fU.mC.mU.fC.mU.fG.mC | 916 | fA.mG.fU.mA.fC.mA.fC.mG.fC.mA.fU.mU.fA.mA.fA |
| F11-167M | 667 | PmU.fU.mA.fA.mU.fG.mU.fG.mU.fA.mU.fC.mC.fA.mG.fA.mG.fA.mU | 917 | fC.mU.fG.mG.fA.mU.fA.mC.fA.mC.fA.mU.fU.mA.fA |
| F11-168M | 668 | PmU.fG.mA.fU.mU.fC.mU.fU.mU.fG.mG.fG.mC.fC.mA.fU.mU.fC.mC | 918 | fU.mG.fG.mC.fC.mC.fA.mA.fA.mG.fA.mA.fU.mC.fA |
| F11-169M | 669 | PmU.fU.mC.fG.mA.fA.mC.fA.mC.fA.mG.fA.mA.fG.mG.fC.mU.fU | 919 | fU.mC.fU.mU.fC.mU.fG.mU.fG.mU.fU.mC.mA.fA |
| F11-170M | 670 | PmU.fC.mA.fC.mA.fC.mA.fU.mU.fC.mA.fC.mC.fA.mG.fA.mA.fA.mC | 920 | fC.mU.fG.mG.fU.mG.fA.mA.fU.mG.fU.mG.fU.mG.fA |
| F11-171M | 671 | PmU.fA.mC.fA.mA.fA.mG.fA.mU.fU.mU.fC.mU.mU.fG.mA | 921 | fA.mA.fA.mG.fA.mA.fA.mU.fC.mU.fU.mU.fG.mU.fA |
| F11-172M | 672 | PmU.fC.mA.fU.mU.fU.mU.fA.mU.fC.mC.fU.mU.fG.mG | 922 | fA.mG.fG.mA.fG.mA.fU.mA.fG.mA.fA.mA.fU.mG.fA |
| F11-173M | 673 | PmU.fU.mU.fU.mC.fU.mG.fU.mA.fA.mC.fA.mC.fU.mG.fU.mU.fC.mU.mU | 923 | fC.mA.fG.mU.fG.mU.fU.mA.fC.mA.fG.mA.fA.mA.fA |
| F11-174M | 674 | PmU.fG.mG.fA.mU.fU.mU.fC.mA.fG.mU.fG.mA.fA.mA.fA.mU.fC.mC | 924 | fU.mU.fU.mC.fA.mC.fU.mG.fA.mA.fA.mU.fC.mC.fA |

TABLE 1b-continued

Summary sequence table for active nucleobase sequences with chemical modifications:

| Oligo Name | construct No | Antisense (Guide) Strand Sequence (5' to 3') | construct No | Sense (Passenger) Strand Sequence (5' to 3') |
|---|---|---|---|---|
| F11-175M | 675 | PmU.fC.mG.fC.mU.fC.mC.fC.mU.fU.mU.fG.mA.fG.mC.fA.mC.fA.mG | 925 | fG.mC.fU.mC.fA.mA.fA.mG.fG.mG.fA.mG.fC.mG.fA |
| F11-176M | 676 | PmU.fC.mA.fG.mU.fC.mC.fA.mC.fG.mU.fA.mC.fU.mC.fG.mA.fC.mC | 926 | fG.mA.fG.mU.fC.mC.fG.mU.fG.mG.fA.mC.fU.mG.fA |
| F11-177M | 677 | PmU.fA.mG.fG.mC.fA.mU.fA.mU.fG.mG.fG.mU.fC.mG.fU.mU.fG.mA | 927 | fC.mG.fA.mC.fC.mC.fA.mU.fA.mU.fG.mC.fC.mU.fA |
| F11-178M | 678 | PmU.fA.mU.fG.mU.fC.mC.fU.mC.fU.mU.fG.mA.fU.mC.fU.mU | 928 | fG.mA.fU.mA.fC.mA.fG.mA.fG.mG.fA.mC.fA.mU.fA |
| F11-179M | 679 | PmU.fG.mC.fU.mU.fG.mA.fU.mU.fU.mU.fG.mG.fU.mG.fG.mU.fA.mC | 929 | fC.mA.fC.mC.fA.mA.fA.mA.fU.mC.fA.mA.fG.mC.fA |
| F11-180M | 680 | PmU.fA.mU.fG.mA.fU.mG.fG.mA.fG.mC.fC.mU.fC.mC.fA.mC.fA.mC | 930 | fG.mG.fA.mG.fG.mC.fU.mC.fC.mA.fU.mC.fA.mU.fA |
| F11-181M | 681 | PmU.fU.mC.fG.mU.fU.mG.fA.mG.fA.mA.fU.mC.fU.mG.fU.mG.fU.mA | 931 | fC.mA.fG.mA.fU.mU.fC.mU.fC.mA.fA.mC.fG.mA.fA |
| F11-182M | 682 | PmU.fU.mU.fA.mU.fC.mC.fA.mU.fU.mU.fA.mU.fA.mA.fC.mA.fC | 932 | fU.mG.fU.mA.fA.mA.fA.mU.fG.mG.fA.mU.fA.mA.fC |
| F11-183M | 683 | PmU.fU.mG.fU.mC.fC.mU.fA.mU.fU.mC.fA.mC.fU.mC.fU.mU.fG.mG | 933 | fG.mA.fG.mU.fG.mA.fA.mU.fA.mG.fG.mA.fC.mA.fA |
| F11-184M | 684 | PmU.fC.mA.fA.mU.fA.mU.fC.mC.fA.mU.fC.mU.mC.fU.mU.fA | 934 | fA.mG.fA.mA.fC.mU.fG.mG.fA.mU.fU.mA.fU.mU.fG.mC | 
| F11-185M | 685 | PmU.fC.mU.fU.mU.fG.mA.fG.mA.fU.mU.fC.mU.fU.mU.fG.mG.fG.mC | 935 | fA.mA.fA.mG.fA.mA.fU.mC.fU.mC.fA.mA.fA.mG.fA |
| F11-186M | 686 | PmU.fC.mA.fC.mU.fC.mU.fU.mG.fG.mC.fA.mG.fU. mG.fU. mU.fU.mC | 936 | fC.mA.fC.mU.fG.mC.fC.mA.fA.mG.fA.mG.fU.mG.fA |
| F11-187M | 687 | PmU.fC.mU.fU.mG.fA.mA.fA.mA.fA.mA.fU.mA.fC.mC.fC.mA.fG.mA | 937 | fG. mG.fU. mA.fU.mU.fC.mU.fU.mU.fC.mA.fA.mG.fA |
| F11-188M | 688 | PmU.fA.mG.fG.mC.fA.mA.fU.mA.fU.mU.fC.mA.mU.fA.mC.fC.mC | 938 | fG.mU.fA.mU.fG.mA.fU.mA.fU.mU.fG.mC.fC.mU.fA |
| F11-189M | 689 | PmU.fC.mU.fG.mU.fG.mU.fA.mA.fU.mU.fC.mA.fC.mU.fG.mU.fG.mG | 939 | fA.mG.fU.mG.fA.mA.fU.mU.fA.mC.fA.mC.fA.mG.fA |
| F11-190M | 690 | PmU.fA.mA.fU.mA.fU.mC.fC.mA.fC.mU.fG.mU.fU.mU.fC.mA | 940 | fA.mA.fG.mC.fA. mG.fU. mG.fG.mA.fU.mA.fU.fA |
| F11-191M | 691 | PmU.fU.mG.fA.mA.fG.mA.fA.mA.fU.mA.fC.mC.fC.mA.fG.mA.fA.mA | 941 | fU.mG.fG.mG.fU.mU.fA.mU.fU.mC.mA.fA |
| F11-192M | 692 | PmU.fG.mU.fU.mA.fA.mU.fA.mU.fC.mC.fA.mC.fU.mG.fG.mU.fU.mU | 942 | fC.mA.fG.mU.fG.mG.fA.mU.fA.mU.fU.mA.mA.fC.fA |
| F11-193M | 693 | PmU.fU. mG.fU. mC.fA.mU.fG. mG.fU. mA.fA.mA.fA.mU.fG.mA.fG | 943 | fA.mU.fU.mU.fU.mA.fC.mC.fA.mU.fG.mA.fC.mA.fA |
| F11-194M | 694 | PmU.fA.mU.fU.mC.fU.mU.fU.mG.fG.mG.fC.mC.fA.mU.fU.mC.fC.mU | 944 | fA.mU.fG.mG.fC.mC.fC.mA.fA.mA.fG.mA.fA.mU.fA |
| F11-195M | 695 | PmU.fC.mA.fG.mU.fU.mC.fC.mU.fC.mU.fC.mU.fC.mA.fA.mC.fG.mA.fU.mC.fC | 945 | fC.mG.fU.mU.fG.mA.fG.mA. mG.fG.mA.fA.mC.fU.mG.fA |
| F11-196M | 696 | PmU.fG.mG.fG.mU.fG.mU.fG.mC.fU.mU.fC.mA.fG.mU.fA.mG.fA.mC | 946 | fA.mC.fU.mG.fA.mA.fG.mC.fA.mC.fA.mC.fC.mC.fA |
| F11-197M | 697 | PmU.fG.mA.fA.mG.fA.mA.fA.mG.fC.mU.fU.mU.fA.mA.fG.mU.fA.mA | 947 | fU.mU.fA.mA.fA.mG.fC.mU.fU.mU.fC.mU.fU.mC.fA |
| F11-198M | 698 | PmU.fA.mU.fC.mC.fU.mG.fA.mA.fA.mA.fG.mA.fC.mC.fU.mU.fG.mU | 948 | fG.mG.fU.mC.fU.mU.fU.mU.fC.mA.fG.mG.fA.mU.fA |
| F11-199M | 699 | PmU.fA.mG.fA.mA.fA.mA.fG.mC.fU.mU.fU.mU.fA.mA.fC.mA | 949 | fA.mC.fU.mU.fA.mA.fA.mA.fG.mC.fU.fU.mU.fC.mU.fA |
| F11-200M | 700 | PmU.fC.mA.fG.mU.fG.mU.fU.mU.fC.mU.fG.mU.fA.mA.fC.mA.fC.mU | 950 | fU.mU.fA.mC.fA.mG.fA.mA.fA.mC.fA.mC.fU.mG.fA |
| F11-201M | 701 | PmU.fG.mA.fC.mA.fC.mG.fC.mA.fA.mA.fC.mU.fU.mA.fG.mG | 951 | fA.mA.fU.mU.fU.mG.fC.mG.fU.mG.fU.mC.fA |
| F11-202M | 702 | PmU.fG.mU.fG.mU.fG.mA.fG.mC.fA.mU.fU.mG.fC.mU.fU.mG.fA.mA | 952 | fA.mG.fC.mA.fA.mU.fG.mC.fU.mC.fA.mC.fA.mC.fA |
| F11-203M | 703 | PmU.fA.mC.fC.mA.fG.mA.fA.mA.fG.mC.fG.mU.fA.mC.fC.mU | 953 | fA.mA.fG.mC.fU.mC.fU.mU.fU.mC.fU.mG.fG.mU.fA |
| F11-204M | 704 | PmU.fA.mG.fA.mA.fA.mG.fU.mG.fC.mA.fC.mA.fG.mG.fA.mU.fU.mU | 954 | fC.mC.fU.mG.fU.mG.fC.mA.fC.mU.fU.mU.fC.mU.fA |
| F11-205M | 705 | PmU.fU.mU.fU.mA.fU.mU.fU.mC.fA.mG.fA.mU.fU.mG.fA.mU.fU.mU | 955 | fC.mA.fA.mU.fC.mU.fG.mA.fA.mA.fU.mA.fA.mA.fA |
| F11-206M | 706 | PmU.fU.mA.fU.mC.fC.mA.fG.mU.fU.mU.fC.mU.fC.mU.fC.mC.mA | 956 | fA.mA.fA.mG.fA.mA.fA.mC.fU.mG.fG.mA.fU.mA.fA |
| F11-207M | 707 | PmU.fC.mC.fG.mU.fG.mA.fA.mA.fG.mU.fG.mA.fA.mG.fU.mA | 957 | f.mU.fU.mC.fA.mC.fU.mU.fC.fA.mC.fG.mG.fA |
| F11-208M | 708 | PmU.fG.mG.fU.mG.fU.mG.fC.mU.fU.mC.fA.mU.fU.mA.fC.mA | 958 | fU.mA.fC.mU.fG.mA.fA.mG.fC.mA.fC.fA.mC.fC.mA |
| F11-209M | 709 | PmU.fG.mG.fA.mC.fA.mG.fA.mG.fG.mG .fC .mC .fU .mC .fC .mC .fG .mA | 959 | fG.mA.fG.mG.fC.mC.fC.mU.fC.mU.fG.mU.fC.mC.fA |
| F11-210M | 710 | PmU.fA.mA.fG.mA.fA.mA.fA.mU.fC.mA.fU.mC.fC.mU.fG.mA.fA.mA | 960 | fA.mG.fG.mA.fU.mG.fA.mU.fU.mU.fU.mU.fC.mU.fU.fA |
| F11-211M | 711 | PmU.fU.mG.fA.mG.fA.mU.fU.mC.fU.mU.fU.mG.fG.mG.fC.mC.fA.mU | 961 | fC.mC.fC.mA.fA.mA.fG.mA.fA.mU.fC.mU.fC.mA.fA |

TABLE 1b-continued

Summary sequence table for active nucleobase sequences with chemical modifications:

| Oligo Name | construct No | Antisense (Guide) Strand Sequence (5' to 3') | construct No | Sense (Passenger) Strand Sequence (5' to 3') |
|---|---|---|---|---|
| F11-212M | 712 | PmU.fA.mU.fG.mU.fU.mU.fU.mA.fA.mG.fG.mA.fG.mA.fC.mA.fA.mA | 962 | fU.mC.fU.mC.fC.mU.fU.mA.fA.mA.fA.mC.fA.mU.fA |
| F11-213M | 713 | PmU.fC.mA.fC.mA.fG.mU.fU.mU.fC.mU.fC.mG.fC.mA.fG.mG.fC.mC | 963 | fU.mG.fC.mC.fA.mG.fA.mA.fA.mC.fU.mG.fU.mG.fA |
| F11-214M | 714 | PmU.fA.mC.fA.mA.fU.mA.fU.mU.fC.mC.fC.mA.fG.mU.fU.mC.fU.mU.fC.mU | 964 | fG.mA.fA.mC.fU.mG.fG.mA.fU.mA.fU.mU.fG.mU.fA |
| F11-215M | 715 | PmU.fA.mC.fA.mU.fU.mC.fA.mC.fC.mA.fG.mA.fA.mA.fC.mU.fG.mA | 965 | fU.mU.fU.mC.fU.mG.fG.mU.fG.mA.fA.mU.fG.mU.fA |
| F11-216M | 716 | PmU.fC.mA.fA.mG.fG.mC.fA.mA.fU.mA.fU.mC.fA.mU.fA.mC.fC.mC | 966 | fA.mU.fG.mA.fU.mA.fU.mU.fG.mC.fC.mU.fU.mG.fA |
| F11-217M | 717 | PmU.fC.mU.fC.mC.fA.mA.fC.mG.fA.mU.fC.mC.fA.mG.fG.mG.fG.mU | 967 | fC.mA.fG.mG.fA.mU.fC.mG.fU.mU.fG.fG.mA.fG.mA |
| F11-218M | 718 | PmU.fC.mU.fG.mA.fA.mA.fC.mC.fA.mG.fA.mA.fA.mG.fA.mG.fC.mU | 968 | fC.mU.fU.mU.fC.mU.fG.mG.fU.mU.fU.mC.fA.mG.fA |
| F11-219M | 719 | PmU.fA.mA.fU.mC.fU.mC.fC.mC.fU.mA.fG.mA.fA.mA.fA.mC.fG.mU | 969 | fU.mU.fG.mC.fA.mA.fG.mG.fG.mA.fG.mA.fU.mU.fA |
| F11-220M | 720 | PmU.fU.mG.fU.mG.fU.mA.fA.mU.fU.mC.fA.mC.fU.mG.fU.mG.fG.mU | 970 | fC.mA.fG.mU.fG.mA.fA.mU.fU.mA.fC.mA.fC.mA.fA |
| F11-221M | 721 | PmU.fU.mU.fU.mC.fA.mG.fU.mG.fA.mC.fA.mA.fA.mA.fA.mA | 971 | fG.mA.fU.mU.fU.mU.fC.mA.fC.mU.fA.mA.fA.mA.fA |
| F11-222M | 722 | PmU.fA.mA.fA.mU.fC.mA.fU.mC.fC.mU.fG.mA.fA.mA.fA.mG.fA.mC | 972 | fU.mU.fU.mC.fA.mG.fG.mA.fU.mU.fU.mA |
| F11-223M | 723 | PmU.fU.mA.fC.mA.fC.mU.fC.mA.fU.mU.fC.mA.fU.mU | 973 | fG.mG.fA.mU.fA.mA.fU.mG.fA.mG.fU.mU.fA |
| F11-224M | 724 | PmU.fU.mU.fG.mG.fC.mA.fG.mU.fG.mU.fU.mU.fC.mU.fG.mU.fA.mA | 974 | fA.mG.fA.mA.fA.mC.fA.mC.fU.mG.fC.mC.fA.mA.fA |
| F11-225M | 725 | PmU.fG.mG.fU.mA.fC.mA.fC.mU.fC.mA.fA.mA.fA.mC.fA.mU | 975 | fA.mU.fA.mA.fU.mG.fA.mG.fU.mG.fU.mA.fC.mC.fA |
| F11-226M | 726 | PmU.fA.mG.fG.mC.fA.mG.fG.mC.fA.mU.fA.mU.fG.mG.fG.mC.mG | 976 | fC.mC.fA.mU.fA.mU.fG.mC.fC.mU.fG.mC.fC.mU.fA |
| F11-227M | 727 | PmU.fC.mC.fA.mG.fU.mU.fU.mC.fA.mA.fC.mA.fA.mG.fC.mA | 977 | fC.mU.fU.mG.fU.mU.fG.mA.fA.mA.fC.mU.fG.mG.fA |
| F11-228M | 728 | PmU.fA.mG.fG.mC.fC.mG.fC.mU.fC.mC.fC.mU.fU.mU.fG.mA.fG.mC | 978 | fA.mA.fA.mG.fG.mG.fA.mG.mC.fG.mC.fC.mA.fA |
| F11-229M | 729 | PmU.fA.mC.fU.mG.fU.mG.fG.mU.fU.mU.fC.mC.fA.mG.fU.mU.fU.mC | 979 | fC.mU.fG.mG.fA.mA.fA.mC.fC.mA.fC.mA.fG.mU.fA |
| F11-230M | 730 | PmU.fC.mU.fU.mU.fG.mG.fG.mC.fC.mA.fU.mU.fC.mC.fU.mG.fG.mG | 980 | fG.mG.fA.mA.fU.mG.mG.fC.mC.fA.mA.fA.mG.fA |
| F11-231M | 731 | PmU.fU.mA.fA.mG.fA.mA.fA.mA.fU.mC.fA.mU.fC.mC.fU.mG.fA.mA | 981 | fG.mG.fA.mU.fG.mA.fU.mU.fU.mU.fC.mU.fU.mA.fA |
| F11-232M | 732 | PmU.fC.mU.fC.mU.fU.mU.fU.mA.fU.mU.fC.mA.fG.mA.fU.mU.fG | 982 | fC.mU.fG.mA.fA.mU.fA.mA.fA.mA.fA.mG.fA.mG.fA |
| F11-233M | 733 | PmU.fU.mC.fU.mU.fU.mG.fA.mG.fA.mU.fU.mC.fU.mU.fU.mG.fG | 983 | fA.mA.fG.mA.fA.mU.fC.mU.fC.mA.fA.mA.fG.mA.fA |
| F11-234M | 734 | PmU.fA.mA.fU.mG.fA.mU.fG.mG.fA.mG.fC.mC.fC.mC.fC.mA | 984 | fG.mA.fG.mG.fC.mU.fC.mC.fA.mU.fC.mA.fU.mU.fA |
| F11-235M | 735 | PmU.fG.mA.fA.mG.fA.mA.fU.mG.fG.mC.fA.mG.fA.mA.fC.mA.fC.mU | 985 | fU.mU.fC.mU.fG.mC.fC.mA.fU.mU.fC.mU.mU.fC.fA |
| F11-236M | 736 | PmU.fC.mA.fA.mU.fG.mA.fU.mG.fG.mA.fG.mC.fC.mU.fC.mC.fA.mC | 986 | fA.mG.fG.mC.fC.mU.fC.mC.fA.mU.fC.mA.fU.fU.mG.fA |
| F11-237M | 737 | PmU.fA.mU.fG.mG.fA.mG.fC.mC.fU.mC.fC.mA.fC.mA.fC.mA.fG.mG | 987 | fU.mG.fU.mG.fG.mA.fG.mG.fC.mU.fC.mC.fA.mU.fA |
| F11-238M | 738 | PmU.fC.mC.fC.mA.fA.mG.fA.mA.fA.mU.fC.mA.fG.mU.fG.mU.fC.mA | 988 | fA.mC.fU.mU.fG.mA.mU.fU.mU.fC.mU.fU.mG.fG.mG.fA |
| F11-239M | 739 | PmU.fG.mA.fG.mC.fC.mU.fC.mC.fA.mC.fA.mC.fA.mG.fG.mU.fG.mU | 989 | fC.mU.fG.mU.fG.mU.fG.mG.fA.mG.fG.mC.fU.mC.fA |
| F11-240M | 740 | PmU.fC.mU.fC.mC.fC.mA.fA.mG.fA.mA.fU.mC.fA.mG.fU.mU | 990 | fU.mG.fA.mU.fU.mU.fC.mU.fU.mG.fA.mG.fA |
| F11-241M | 741 | PmU.fC.mC.fU.mC.fC.mA.fC.mA.fC.mA.fG.mG.fU.mG.fU.mC | 991 | fC.mA.fC.mC.fU.mG.fU.mG.fU.mG.fG.mA.fG.mG.fA |
| F11-242M | 742 | PmU.fC.mC.fA.mA.fU.mG.fA.mU.fG.mG fA. mG .fC. mC .fU. mC .fC. m A | 992 | fG.mG.fC.mU.fC.mC.fA.mU.fC.mA.fU.mU.fG.mG.fA |
| F11-243M | 743 | PmU.fU.mU.fU.mC.fC.mA.fA.mU.fG.mU.fG.mG.fG.mA.fG.mC.fC.mU | 993 | fU.mC.fC.mA.fC.mA.fU.mU.fG.mA.fA.mA.fA |
| F11-244M | 744 | PmU.fU.mC.fC.mC.fA.mA.fG.mA.fA.mA.fU.mC.fA.mG.fU.mG.fU.mC | 994 | fC.mU.fG.mA.fU.mU.fU.mC.fU.mU.fG.mG.fG.mA.fA |
| F11-245M | 745 | PmU.fA.mG.fC.mC.fU.mC.fC.mA.fC.mA.fG.mG.fU.mU.fC | 995 | fC.mC.fU.mG.fU.mG.fU.mG.fG.mA.fG.mG.fC.mU.fA |
| F11-246M | 746 | PmU.fU.mC.fU.mU.fC.mU.fC.mC.fA.mA.fG.mA.fA.mA.fU.mC.fA | 996 | fU.mU.fC.mU.fU.mG.fG.mG.fA.mG.fA.mA.fG.mA.fA |
| F11-247M | 747 | PmU.fG.mU.fU.mU.fC.mC.fA.mA.fU.mG.fA.mU.fG.mG.fA.mG.fC.mC | 997 | fC.mC.fA.mU.fC.mA.fU.mU.fG.mG.fA.mA.fA.mC.fA |
| F11-248M | 748 | PmU.fU.mC.fC.mA.fA.mU.fG.mA.fU.mG.fG.mA.fG.mC.fC.mU.fC.mC | 998 | fG.mC.fU.mC.fC.mA.fU.mC.fA.mU.fU.mG.fG.mA.fA |

TABLE 1b-continued

Summary sequence table for active nucleobase sequences with chemical modifications:

| Oligo Name | construct No | Antisense (Guide) Strand Sequence (5' to 3') | construct No | Sense (Passenger) Strand Sequence (5' to 3') |
|---|---|---|---|---|
| F11-249M | 749 | PmU.fU.mG.fG.mA.fG.mC.fC.mU.fC.mC.fA.mC.fA.mC.fA.mG.fG.mU | 999 | fG.mU.fG.mU.fG.mG.fA.mG.fG.mC.fU.mC.fC.mA.fA |
| F11-250M | 750 | PmU.fG.mC.fC.mU.fC.mC.fA.mC.fA.mC.fA.mG.fG.mU.fG.mU.fC.mU | 1000 | fA.mC.fC.mU.fG.mU.fG.mU.fG.mG.fA.mG.fG.mC.fA |

In above Table 1b:
A represents adenine;
U represents uracil;
C represents cytosine;
G represents guanine;
P represents a terminal phosphate group;
m represents a methyl modification at the 2' position of the sugar of the underlying nucleoside;
f represents a fluoro modification at the 2' position of the sugar of the underlying nucleoside.

The target sequences in the Factor XI gene, with which the antisense (guide) sequences of Tables 1a/1b interact are set out in Table 1c below.

TABLE 1c

Summary sequence table for the nucleobases of the target gene:

| Oligo Name | Seq ID No | Target sequence (5' to 3') |
|---|---|---|
| F11-01T | 1001 | GAGUCACCUAAGAUUUUGC |
| F11-02T | 1002 | GUGGCAUUUUAAAUCAAUC |
| F11-03T | 1003 | AGGACAGCAGCGAUUUCUG |
| F11-04T | 1004 | UCAGGAUGAUUUUCUUAUA |
| F11-05T | 1005 | UUCCCUAAUACGGUGUUUG |
| F11-06T | 1006 | UUACCAUGACACUGAUUUC |
| F11-07T | 1007 | AUGGCAGAAAGCGGGUAUG |
| F11-08T | 1008 | UGUCUCCUUAAAACAUCUG |
| F11-09T | 1009 | CCAGAAAGCCAAGAUACCC |
| F11-10T | 1010 | GCCAGAAGAGAUACAGAGG |
| F11-11T | 1011 | CAAGAAAUAAUAAUCCAUG |
| F11-12T | 1012 | GCACUUUCUAAUCUGGCUU |
| F11-13T | 1013 | GCACCAAUGCCGUCCGCUG |
| F11-14T | 1014 | UUUAAAUCAAUCUGAAAUA |
| F11-15T | 1015 | CAGAAAACUAAGAGACAAA |
| F11-16T | 1016 | ACAGCAUCCCAGUGUUCUG |
| F11-17T | 1017 | UUUUCUUAUAUCAAGUGGU |
| F11-18T | 1018 | GGUGUUUGUAAGAAAAUGC |
| F11-19T | 1019 | UGCCCAGUACACGCAUUAA |
| F11-20T | 1020 | CGGGAGGCCCUCUGUCCUG |
| F11-21T | 1021 | CACUCAUCAUCCCGGUUGC |
| F11-22T | 1022 | CUCAAAGAAAUCUUUGUCU |
| F11-23T | 1023 | GUGCCAGCAUGCUUCCUCC |
| F11-24T | 1024 | GUAUUAGGGACAUUUUCCC |
| F11-25T | 1025 | AGGGCAAGUGUUACUUAAA |
| F11-26T | 1026 | AAAGCGGGUAUGAUAUUGC |
| F11-27T | 1027 | AUAUCAAGUGGUACAUUUC |
| F11-28T | 1028 | UUUUCAGGAUGAUUUUCUU |
| F11-29T | 1029 | AGGGAAGGGCAAGUGUUAC |
| F11-30T | 1030 | UGUUUGUAAGAAAAUGCUA |
| F11-31T | 1031 | UCCCUAAUACGGUGUUUGC |
| F11-32T | 1032 | UGGAUAUUAACAGCCGCUC |
| F11-33T | 1033 | GGAUAUUAACAGCCGCUCA |
| F11-34T | 1034 | CAAAGAAAUCUUUGUCUCC |
| F11-35T | 1035 | AGGACAUAAAAUAACCCAU |
| F11-36T | 1036 | UCGACAGUGUCAUGGCUCC |
| F11-37T | 1037 | UGUGCACUUUCUAAUCUGG |
| F11-38T | 1038 | GCGAUUUCUGGGUAUUCUU |
| F11-39T | 1039 | GUCUCCUUAAAACAUCUGA |
| F11-40T | 1040 | GAGGCAUCUCUGGAUACAC |
| F11-41T | 1041 | CUGGUGAAUGUGUGACUCA |
| F11-42T | 1042 | AGGACACAUCUUUCUUUGG |
| F11-43T | 1043 | UUUCUUAUAUCAAGUGGUA |
| F11-44T | 1044 | GUUACUUAAAGCUUUCUUC |
| F11-45T | 1045 | UAAAUCAAUCUGAAAUAAA |
| F11-46T | 1046 | CAAGCAAUGCUCACACCAA |
| F11-47T | 1047 | AGGUCUUUCAGGAUGAUU |
| F11-48T | 1048 | CUUUCAAGCAAUGCUCACA |
| F11-49T | 2293 | GUGCCAGAAGAGAUACAGA |
| F11-50T | 1050 | CUGGAUACACAUUAAGGUU |
| F11-51T | 1051 | GAAAUAAUAAUCCAUGAUC |

TABLE 1c-continued

Summary sequence table for the nucleobases of the target gene:

| Oligo Name | Seq ID No | Target sequence (5' to 3') |
|---|---|---|
| F11-52T | 1052 | AUCUCAAAGAAAUCUUUGU |
| F11-53T | 1053 | CUCCAACUAAAAUACUUCA |
| F11-54T | 1054 | GGCAUUUUAAAUCAAUCUG |
| F11-55T | 1055 | CAGAAAGCCAAGAUACCCU |
| F11-56T | 1056 | AAGAAAUCUUUGUCUCCUU |
| F11-57T | 1057 | UCUUCAUUUUACCAUGACA |
| F11-58T | 1058 | GGGAGAAGAACUGGAUAUU |
| F11-59T | 1059 | GGAGAAGAACUGGAUAUUG |
| F11-60T | 1060 | UGAAACUGGAAACCACAGU |
| F11-61T | 1061 | CUGUGCACUUUCUAAUCUG |
| F11-62T | 1062 | ACCAUGACACUGAUUUCUU |
| F11-63T | 1063 | UCAAGAAAUAAUAAUCCAU |
| F11-64T | 1064 | GUGCACUUUCUAAUCUGGC |
| F11-65T | 1065 | UGUAAAAUGGAUAAUGAGU |
| F11-66T | 1066 | UUCCCAGGAAUGGCCCAAA |
| F11-67T | 1067 | CCACCAAAAUCAAGCCCAG |
| F11-68T | 1068 | GCAUUUUAAAUCAAUCUGA |
| F11-69T | 1069 | UCAUCAUCCCGGUUGCUUG |
| F11-70T | 1070 | CUCUGGAUACACAUUAAGG |
| F11-71T | 1071 | GAAACCACAGUGAAUUACA |
| F11-72T | 1072 | CAAAGGAGAUAGAAAUGUA |
| F11-73T | 1073 | CAUCAUUGGAAACCAGUGG |
| F11-74T | 1074 | AGUGAAUUACACAGAUUCU |
| F11-75T | 1075 | GCCAAGAGUGAAUAGGACA |
| F11-76T | 1076 | AUUCUUUCAAGCAAUGCUC |
| F11-77T | 1077 | CAGCGAUUUCUGGGUAUUC |
| F11-78T | 1078 | GGUUCAAGAAAUAAUAAUC |
| F11-79T | 1079 | UCUCCAACUAAAAUACUUC |
| F11-80T | 1080 | AGUACGUGGACUGGAUUCU |
| F11-81T | 1081 | UCAAAGAAAUCUUUGUCUC |
| F11-82T | 1082 | UUUUCACUGAAAUCCUGUG |
| F11-83T | 1083 | GUAUGAUAUUGCCUUGUUG |
| F11-84T | 1084 | CGGGUAUGAUAUUGCCUUG |
| F11-85T | 1085 | GCAGCGAUUUCUGGGUAUU |
| F11-86T | 1086 | UGGCAUUUUAAAUCAAUCU |
| F11-87T | 1087 | CUGCCAAGAGUGAAUAGGA |
| F11-88T | 1088 | AAGAUUUGCGUGUCUACA |
| F11-89T | 1089 | GAUUCUGGAGAAAACUCAA |
| F11-90T | 1090 | AAAGAAUCUCAAAGAAAUC |
| F11-91T | 1091 | CAGGAUGAUUUUCUUAUAU |
| F11-92T | 1092 | AGAGUCACCUAAGAUUUUG |
| F11-93T | 1093 | GGCACAGCAUCCCAGUGUU |
| F11-94T | 1094 | UCACUGAAAUCCUGUGCAC |
| F11-95T | 1095 | UUCUAAUCUGGCUUGUAUU |
| F11-96T | 1096 | UUGAAACUGGAAACCACAG |
| F11-97T | 1097 | GCAACGAAGGGAAGGGCAA |
| F11-98T | 1098 | UCUUUCAGGAUGAUUUUC |
| F11-99T | 1099 | AUGACACUGAUUUCUUGGG |
| F11-100T | 1100 | CUCAACGACCCAUAUGCCU |
| F11-101T | 1101 | GUGAAUUACACAGAUUCUC |
| F11-102T | 1102 | CGAGUACGUGGACUGGAUU |
| F11-103T | 1103 | CCAGAAGAGAUACAGAGGA |
| F11-104T | 1104 | UUCACUGAAAUCCUGUGCA |
| F11-105T | 1105 | UGCCAUUCUUCAUUUUACC |
| F11-106T | 1106 | ACACAGAUUCUCAACGACC |
| F11-107T | 1107 | AGAACUGGAUAUUGUUGCU |
| F11-108T | 1108 | CACCAAUGCCGUCCGCUGC |
| F11-109T | 1109 | GUGUUACUUAAAGCUUUCU |
| F11-110T | 1110 | GUGUUACAGAAACACUGCC |
| F11-111T | 1111 | UGAAUUACACAGAUUCUCA |
| F11-112T | 1112 | UCGAGUACGUGGACUGGAU |
| F11-113T | 1113 | UUUCAAGCAAUGCUCACAC |
| F11-114T | 1114 | CUGCACUCAUCAUCCCGGU |
| F11-115T | 1115 | CGAAGCUCGAUAAAGUGGU |
| F11-116T | 1116 | UGUGUAAAAUGGAUAAUGA |
| F11-117T | 1117 | GCACUCAUCAUCCCGGUUG |
| F11-118T | 1118 | CAGGAAUGGCCCAAAGAAU |
| F11-119T | 1119 | AAGCCAAGAUACCCUUAGU |
| F11-120T | 1120 | AAGCAAUGCUCACACCAAA |
| F11-121T | 1121 | UUCUCAACGACCCAUAUGC |
| F11-122T | 1122 | UCUCUGGAUACACAUUAAG |
| F11-123T | 1123 | UCUCCUUAAAACAUCUGAG |
| F11-124T | 1124 | GAGGCUCCAUCAUUGGAAA |
| F11-125T | 1125 | GUACGUGGACUGGAUUCUG |

TABLE 1c-continued

Summary sequence table for the nucleobases of the target gene:

| Oligo Name | Seq ID No | Target sequence (5' to 3') |
|---|---|---|
| F11-126T | 1126 | GGCCCAAAGAAUCUCAAAG |
| F11-127T | 1127 | GGUCUUUUCAGGAUGAUUU |
| F11-128T | 1128 | CUAAGAUUUUGCGUGUCUA |
| F11-129T | 1129 | CCAACGUGGUCGAGUACGU |
| F11-130T | 1130 | UUGCUGGGUGACUGGAUGG |
| F11-131T | 1131 | GCACAGCAUCCCAGUGUUC |
| F11-132T | 1132 | AGAGCAAAGCUCUUUCUGG |
| F11-133T | 1133 | CCAAAGAAUCUCAAAGAAA |
| F11-134T | 1134 | GAACUGGAUAUUGUUGCUG |
| F11-135T | 1135 | GAAGCUCGAUAAAGUGGUG |
| F11-136T | 1136 | CUGCAACGAAGGGAAGGGC |
| F11-137T | 1137 | GUCACCUAAGAUUUUGCGU |
| F11-138T | 1138 | CCUCCACAGUAACACGCUG |
| F11-139T | 1139 | CCGGCUACAGGGAAGGAGG |
| F11-140T | 1140 | AGAAGAGAUACAGAGGACA |
| F11-141T | 1141 | UCCAGAAAGCCAAGAUACC |
| F11-142T | 1142 | CAGAAACACUGCCAAGAGU |
| F11-143T | 1143 | UACCAUGACACUGAUUUCU |
| F11-144T | 1144 | GUGCCGGCUACAGGGAAGG |
| F11-145T | 1145 | CUCAAAGGGAGCGGCCAGG |
| F11-146T | 1146 | CACCUAAGAUUUUGCGUGU |
| F11-147T | 1147 | AAAGCUCUUUCUGGUUUCA |
| F11-148T | 1148 | AGUGUUACUUAAAGCUUUC |
| F11-149T | 1149 | CUUUCUAAUCUGGCUUGUA |
| F11-150T | 1150 | GUAAAAUGGAUAAUGAGUG |
| F11-151T | 1151 | CAACAAGGUCUUUUCAGGA |
| F11-152T | 1152 | GCUCCAUCAUUGGAAACCA |
| F11-153T | 1153 | GAGGCCUGCCAGAAACUGU |
| F11-154T | 1154 | AUCCCAGUGUUCUGCCAUU |
| F11-155T | 1155 | AGAAUCUCAAAGAAAUCUU |
| F11-156T | 1156 | CUUGUUGAAACUGGAAACC |
| F11-157T | 1157 | CAGAAGAGAUACAGAGGAC |
| F11-158T | 1158 | CAAGGUCUUUUCAGGAUGA |
| F11-159T | 1159 | AUUCUGGAGAAAACUCAAG |
| F11-160T | 1160 | UGGAAACCACAGUGAAUUA |
| F11-161T | 1161 | GAAUCUCAAAGAAAUCUUU |
| F11-162T | 1162 | AAAGAAAUCUUUGUCUCCU |
| F11-163T | 1163 | CUUUUCAGGAUGAUUUUCU |
| F11-164T | 1164 | GUAUAAAAUGGCAGAAAGC |
| F11-165T | 1165 | UGGUCGAGUACGUGGACUG |
| F11-166T | 1166 | GCCCAGUACACGCAUUAAA |
| F11-167T | 1167 | AUCUCUGGAUACACAUUAA |
| F11-168T | 1168 | GGAAUGGCCCAAAGAAUCU |
| F11-169T | 1169 | AAGCUCUUUCUGGUUUCAG |
| F11-170T | 1170 | GUUUCUGGUGAAUGUGUGA |
| F11-171T | 1171 | UCUCAAAGAAAUCUUUGUC |
| F11-172T | 1172 | CCAAAGGAGAUAGAAAUGU |
| F11-173T | 1173 | AAGACAGUGUUACAGAAAC |
| F11-174T | 1174 | GGAUUUUCACUGAAAUCCU |
| F11-175T | 1175 | CUGUGCUCAAAGGGAGCGG |
| F11-176T | 1176 | GGUCGAGUACGUGGACUGG |
| F11-177T | 1177 | UCAACGACCCAUAUGCCUG |
| F11-178T | 1178 | AAGAGAUACAGAGGACAUA |
| F11-179T | 1179 | GUACCACCAAAAUCAAGCC |
| F11-180T | 1180 | GUGUGGAGGCUCCAUCAUU |
| F11-181T | 1181 | UACACAGAUUCUCAACGAC |
| F11-182T | 1182 | GUUGUGUAAAAUGGAUAAU |
| F11-183T | 1183 | CCAAGAGUGAAUAGGACAG |
| F11-184T | 1184 | GAGAAGAACUGGAUAUUGU |
| F11-185T | 1185 | GCCCAAAGAAUCUCAAAGA |
| F11-186T | 1186 | GAAACACUGCCAAGAGUGA |
| F11-187T | 1187 | UCUGGGUAUUCUUUCAAGC |
| F11-188T | 1188 | GCGGGUAUGAUAUUGCCUU |
| F11-189T | 1189 | CCACAGUGAAUUACACAGA |
| F11-190T | 1190 | UGGAAACCAGUGGAUAUUA |
| F11-191T | 1191 | UUUCGGGUAUUCUUUCAA |
| F11-192T | 1192 | AAACCAGUGGAUAUUAACA |
| F11-193T | 1193 | CUUCAUUUACCAUGACAC |
| F11-194T | 1194 | AGGAAUGGCCCAAAGAAUC |
| F11-195T | 1195 | GGAUCGUUGGAGGAACUGC |
| F11-196T | 1196 | GUCUACUGAAGCACACCCA |
| F11-197T | 1197 | UUACUUAAAGCUUUCUUCA |
| F11-198T | 1198 | ACAAGGUCUUUUCAGGAUG |
| F11-199T | 1199 | UGUUACUUAAAGCUUUCUU |

TABLE 1c-continued

Summary sequence table for the nucleobases of the target gene:

| Oligo Name | Seq ID No | Target sequence (5' to 3') |
|---|---|---|
| F11-200T | 1200 | AGUGUUACAGAAACACUGC |
| F11-201T | 1201 | CCUAAGAUUUUGCGUGUCU |
| F11-202T | 1202 | UUCAAGCAAUGCUCACACC |
| F11-203T | 1203 | AGCAAAGCUCUUUCUGGUU |
| F11-204T | 1204 | AAAUCCUGUGCACUUUCUA |
| F11-205T | 1205 | AAAUCAAUCUGAAAUAAAA |
| F11-206T | 1206 | UGGGAGAAGAACUGGAUAU |
| F11-207T | 1207 | UACUCUUCACUUUCACGGC |
| F11-208T | 1208 | UGUCUACUGAAGCACACCC |
| F11-209T | 1209 | UCGGGAGGCCCUCUGUCCU |
| F11-210T | 1210 | UUUCAGGAUGAUUUUCUUA |
| F11-211T | 1211 | AUGGCCCAAAGAAUCUCAA |
| F11-212T | 1212 | UUUGUCUCCUUAAAACAUC |
| F11-213T | 1213 | GGCCUGCCAGAAACUGUGC |
| F11-214T | 1214 | AGAAGAACUGGAUAUUGUU |
| F11-215T | 1215 | UCAGUUUCUGGUGAAUGUG |
| F11-216T | 1216 | GGGUAUGAUAUUGCCUUGU |
| F11-217T | 1217 | AGCCCAGGAUCGUUGGAGG |
| F11-218T | 1218 | AGCUCUUUCUGGUUUCAGU |
| F11-219T | 1219 | ACGCUUGCAAGGGAGAUUC |
| F11-220T | 1220 | ACCACAGUGAAUUACACAG |
| F11-221T | 1221 | UCUGGAUUUUCACUGAAAU |
| F11-222T | 1222 | GUCUUUUCAGGAUGAUUUU |
| F11-223T | 1223 | AAAUGGAUAAUGAGUGUAC |
| F11-224T | 1224 | UUACAGAAACACUGCCAAG |
| F11-225T | 1225 | AUGGAUAAUGAGUGUACCA |
| F11-226T | 1226 | CGACCCAUAUGCCUGCCUU |
| F11-227T | 1227 | UUGCCUUGUUGAAACUGGA |
| F11-228T | 1228 | GCUCAAAGGGAGCGGCCAG |
| F11-229T | 1229 | GAAACUGGAAACCACAGUG |
| F11-230T | 1230 | CCCAGGAAUGGCCCAAAGA |
| F11-231T | 1231 | UUCAGGAUGAUUUUCUUAU |
| F11-232T | 1232 | CAAUCUGAAAUAAAAGAGG |
| F11-233T | 1233 | CCCAAAGAAUCUCAAAGAA |
| F11-234T | 1234 | UGUGGAGGCUCCAUCAUUG |
| F11-235T | 1235 | AGUGUUCUGCCAUUCUUCA |
| F11-236T | 1236 | GUGGAGGCUCCAUCAUUGG |
| F11-237T | 1237 | CCUGUGUGGAGGCUCCAUC |
| F11-238T | 1238 | UGACACUGAUUUCUUGGGA |
| F11-239T | 1239 | ACACCUGUGUGGAGGCUCC |
| F11-240T | 1240 | ACACUGAUUUCUUGGGAGA |
| F11-241T | 1241 | GAGACACCUGUGUGGAGGC |
| F11-242T | 1242 | UGGAGGCUCCAUCAUUGGA |
| F11-243T | 1243 | AGGCUCCAUCAUUGGAAAC |
| F11-244T | 1244 | GACACUGAUUUCUUGGGAG |
| F11-245T | 1245 | GACACCUGUGUGGAGGCUC |
| F11-246T | 1246 | UGAUUUCUUGGGAGAAGAA |
| F11-247T | 1247 | GGCUCCAUCAUUGGAAACC |
| F11-248T | 1248 | GGAGGCUCCAUCAUUGGAA |
| F11-249T | 1249 | ACCUGUGUGGAGGCUCCAU |
| F11-250T | 1250 | AGACACCUGUGUGGAGGCU |

In above Table 1c:

A represents adenine;

U represents uracil;

C represents cytosine;

G represents guanine.

It should also be noted that the scope of the present embodiments extends to sequences that correspond to those in Table 1a or Table 1b, and wherein the 5' nucleoside of the antisense (guide) strand (first region as defined herein) can include any nucleobase that can be present in an RNA molecule, in other words can be any of adenine (A), uracil (U), guanine or cytosine (C). Additionally, the scope of the present embodiments extends to sequences that correspond to those in Table 1a or Table 1b, and wherein the 3' nucleoside of the sense (passenger) strand (second region as defined herein) can include any nucleobase that can be present in an RNA molecule, in other words can be any of adenine (A), uracil (U), guanine or cytosine (C), preferably however a nucleobase that is complementary to the 5' nucleobase of the antisense (guide) strand (first region as defined herein). These further sequences are shown in Tables 1d (unmodified) and 1e (chemically modified), where N and N' respectively represent any RNA nucleobase that can be present in the 5' terminal position of the antisense (guide) strand (first region as defined herein) and in the 3' terminal position of the sense (passenger) strand (second region as defined herein).

TABLE 1d

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-01N | 1251 | NCAAAAUCUUAGGUGACUC | 1501 | CACCUAAGAUUUUGN' |
| F11-02N | 1252 | NAUUGAUUUAAAAUGCCAC | 1502 | CAUUUUAAAUCAAUN' |
| F11-03N | 1253 | NAGAAAUCGCUGCUGUCCU | 1503 | CAGCAGCGAUUUCUN' |
| F11-04N | 1254 | NAUAAGAAAAUCAUCCUGA | 1504 | GAUGAUUUUCUUAUN' |
| F11-05N | 1255 | NAAACACCGUAUUAGGGAA | 1505 | CUAAUACGGUGUUUN' |
| F11-06N | 1256 | NAAAUCAGUGUCAUGGUAA | 1506 | CAUGACACUGAUUUN' |
| F11-07N | 1257 | NAUACCCGCUUUCUGCCAU | 1507 | CAGAAAGCGGGUAUN' |
| F11-08N | 1258 | NAGAUGUUUUAAGGAGACA | 1508 | UCCUUAAAACAUCUN' |
| F11-09N | 1259 | NGGUAUCUUGGCUUUCUGG | 2294 | AAAGCCAAGAUACCN' |
| F11-10N | 1260 | NCUCUGUAUCUCUUCUGGC | 1510 | GAAGAGAUACAGAGN' |
| F11-11N | 1261 | NAUGGAUUAUUAUUUCUUG | 1511 | AAAUAAUAAUCCAUN' |
| F11-12N | 1262 | NAGCCAGAUUAGAAAGUGC | 1512 | UUUCUAAUCUGGCUN' |
| F11-13N | 1263 | NAGCGGACGGCAUUGGUGC | 1513 | CAAUGCCGUCCGCUN' |
| F11-14N | 1264 | NAUUUCAGAUUGAUUUAAA | 1514 | AAUCAAUCUGAAAUN' |
| F11-15N | 1265 | NUUGUCUCUUAGUUUUCUG | 1515 | AAACUAAGAGACAAN' |
| F11-16N | 1266 | NAGAACACUGGGAUGCUGU | 1516 | CAUCCCAGUGUUCUN' |
| F11-17N | 1267 | NCCACUUGAUAUAAGAAAA | 1517 | CUUAUAUCAAGUGGN' |
| F11-18N | 1268 | NCAUUUCUUACAAACACC | 1518 | UUUGUAAGAAAAUGN' |
| F11-19N | 1269 | NUAAUGCGUGUACUGGGCA | 1519 | CAGUACACGCAUUAN' |
| F11-20N | 1270 | NAGGACAGAGGGCCUCCCG | 1520 | AGGCCCUCUGUCCUN' |
| F11-21N | 1271 | NCAACCGGGAUGAUGAGUG | 1521 | CAUCAUCCCGGUUGN' |
| F11-22N | 1272 | NGACAAAGAUUUCUUUGAG | 1522 | AAGAAAUCUUUGUCN' |
| F11-23N | 1273 | NGAGGAAGCAUGCUGGCAC | 1523 | CAGCAUGCUUCCUCN' |
| F11-24N | 1274 | NGGAAAAUGUCCCUAAUAC | 1524 | UAGGGACAUUUCCN' |
| F11-25N | 1275 | NUUAAGUAACACUUGCCCU | 1525 | CAAGUGUUACUUAAN' |

TABLE 1d-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-26N | 1276 | NCAAUAUCAUACCCGCUUU | 1526 | CGGGUAUGAUAUUGN' |
| F11-27N | 1277 | NAAAUGUACCACUUGAUAU | 1527 | CAAGUGGUACAUUUN' |
| F11-28N | 1278 | NAGAAAAUCAUCCUGAAAA | 1528 | CAGGAUGAUUUUCUN' |
| F11-29N | 1279 | NUAACACUUGCCCUUCCCU | 1529 | AAGGGCAAGUGUUAN' |
| F11-30N | 1280 | NAGCAUUUCUUACAAACA | 1530 | UGUAAGAAAAUGCUN' |
| F11-31N | 1281 | NCAAACACCGUAUUAGGGA | 1531 | UAAUACGGUGUUUGN' |
| F12-32N | 1282 | NAGCGGCUGUUAAUAUCCA | 1532 | UAUUAACAGCCGCUN' |
| F11-33N | 1283 | NGAGCGGCUGUUAAUAUCC | 1533 | AUUAACAGCCGCUCN' |
| F11-34N | 1284 | NGAGACAAAGAUUUCUUUG | 1534 | GAAAUCUUUGUCUCN' |
| F11-35N | 1285 | NUGGGUUAUUUUAUGUCCU | 1535 | CAUAAAAUAACCCAN' |
| F11-36N | 1286 | NGAGCCAUGACACUGUCGA | 1536 | CAGUGUCAUGGCUCN' |
| F11-37N | 1287 | NCAGAUUAGAAAGUGCACA | 1537 | CACUUUCUAAUCUGN' |
| F11-38N | 1288 | NAGAAUACCCAGAAAUCGC | 1538 | UUUCGGGUAUUCUN' |
| F11-39N | 1289 | NCAGAUGUUUUAAGGAGAC | 1539 | CCUUAAAACAUCUGN' |
| F11-40N | 1290 | NUGUAUCCAGAGAUGCCUC | 1540 | CAUCUCUGGAUACAN' |
| F11-41N | 1291 | NGAGUCACACAUUCACCAG | 1541 | UGAAUGUGUGACUCN' |
| F11-42N | 1292 | NCAAAGAAAGAUGUGUCCU | 1542 | CACAUCUUUCUUUGN' |
| F11-43N | 1293 | NACCACUUGAUAUAAGAAA | 1543 | UUAUAUCAAGUGGUN' |
| F11-44N | 2295 | UAAGAAAGCUUUAAGUAAC | 1544 | CUUAAAGCUUUCUUN' |
| F11-45N | 1295 | NUUAUUUCAGAUUGAUUUA | 1545 | UCAAUCUGAAAUAAN' |
| F11-46N | 1296 | NUGGUGUGAGCAUUGCUUG | 1546 | CAAUGCUCACACCAN' |
| F11-47N | 1297 | NAUCAUCCUGAAAAGACCU | 1547 | CUUUUCAGGAUGAUN' |
| F11-48N | 1298 | NGUGAGCAUUGCUUGAAAG | 1548 | CAAGCAAUGCUCACN' |
| F11-49N | 1299 | NCUGUAUCUCUUCUGGCAC | 1549 | CAGAAGAGAUACAGN' |
| F11-50N | 1300 | NACCUUAAUGUGUAUCCAG | 1550 | AUACACAUUAAGGUN' |

TABLE 1d-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-51N | 1301 | NAUCAUGGAUUAUUAUUUC | 1551 | UAAUAAUCCAUGAUN' |
| F11-52N | 1302 | NCAAAGAUUUCUUUGAGAU | 1552 | CAAAGAAAUCUUUGN' |
| F11-53N | 1303 | NGAAGUAUUUUAGUUGGAG | 1553 | AACUAAAAUACUUCN' |
| F11-54N | 1304 | NAGAUUGAUUUAAAAUGCC | 1554 | UUUUAAAUCAAUCUN' |
| F11-55N | 1305 | NGGGUAUCUUGGCUUUCUG | 1555 | AAGCCAAGAUACCCN' |
| F11-56N | 1306 | NAGGAGACAAAGAUUUCUU | 1556 | AAUCUUUGUCUCCUN' |
| F11-57N | 1307 | NGUCAUGGUAAAAUGAAGA | 1557 | CAUUUUACCAUGACN' |
| F11-58N | 1308 | NAUAUCCAGUUCUUCUCCC | 1558 | GAAGAACUGGAUAUN' |
| F11-59N | 1309 | NAAUAUCCAGUUCUUCUCC | 1559 | AAGAACUGGAUAUUN' |
| F11-60N | 1310 | NCUGUGGUUUCCAGUUUCA | 1560 | ACUGGAAACCACAGN' |
| F11-61N | 1311 | NAGAUUAGAAAGUGCACAG | 1561 | GCACUUUCUAAUCUN' |
| F11-62N | 1312 | NAGAAAUCAGUGUCAUGGU | 1562 | UGACACUGAUUUCUN' |
| F11-63N | 1313 | NUGGAUUAUUAUUUCUUGA | 1563 | GAAAUAAUAAUCCAN' |
| F11-64N | 1314 | NCCAGAUUAGAAAGUGCAC | 1564 | ACUUUCUAAUCUGGN' |
| F11-65N | 1315 | NCUCAUUAUCCAUUUUACA | 1565 | AAAUGGAUAAUGAGN' |
| F11-66N | 1316 | NUUGGGCCAUUCCUGGGAA | 1566 | CAGGAAUGGCCCAAN' |
| F11-67N | 1317 | NUGGGCUUGAUUUUGGUGG | 1567 | CAAAAUCAAGCCCAN' |
| F11-68N | 1318 | NCAGAUUGAUUUAAAAUGC | 1568 | UUUAAAUCAAUCUGN' |
| F11-69N | 1319 | NAAGCAACCGGGAUGAUGA | 1569 | CAUCCCGGUUGCUUN' |
| F11-70N | 1320 | NCUUAAUGUGUAUCCAGAG | 1570 | GGAUACACAUUAAGN' |
| F11-71N | 1321 | NGUAAUUCACUGUGGUUUC | 1571 | CCACAGUGAAUUACN' |
| F11-72N | 1322 | NACAUUUCUAUCUCCUUUG | 1572 | GGAGAUAGAAAUGUN' |
| F11-73N | 1323 | NCACUGGUUUCCAAUGAUG | 1573 | AUUGGAAACCAGUGN' |
| F11-74N | 1324 | NGAAUCUGUGUAAUUCACU | 1574 | AAUUACACAGAUUCN' |
| F11-75N | 1325 | NGUCCUAUUCACUCUUGGC | 1575 | AGAGUGAAUAGGACN' |

TABLE 1d-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-76N | 1326 | NAGCAUUGCUUGAAAGAAU | 1576 | UUUCAAGCAAUGCUN' |
| F11-77N | 1327 | NAAUACCCAGAAAUCGCUG | 1577 | GAUUUCUGGGUAUUN' |
| F11-78N | 1328 | NAUUAUUAUUUCUUGAACC | 1578 | CAAGAAAUAAUAAUN' |
| F11-79N | 1329 | NAAGUAUUUUAGUUGGAGA | 1579 | CAACUAAAAUACUUN' |
| F11-80N | 1330 | NGAAUCCAGUCCACGUACU | 1580 | CGUGGACUGGAUUCN' |
| F11-81N | 1331 | NAGACAAAGAUUUCUUUGA | 1581 | AGAAAUCUUUGUCUN' |
| F11-82N | 1332 | NACAGGAUUUCAGUGAAAA | 1582 | CACUGAAAUCCUGUN' |
| F11-83N | 1333 | NAACAAGGCAAUAUCAUAC | 1583 | GAUAUUGCCUUGUUN' |
| F11-84N | 1334 | NAAGGCAAUAUCAUACCCG | 1584 | UAUGAUAUUGCCUUN' |
| F11-85N | 1335 | NAUACCCAGAAAUCGCUGC | 1585 | CGAUUUCUGGGUAUN' |
| F11-86N | 1336 | NGAUUGAUUUAAAAUGCCA | 1586 | AUUUUAAAUCAAUCN' |
| F11-87N | 1337 | NCCUAUUCACUCUUGGCAG | 1587 | CAAGAGUGAAUAGGN' |
| F11-88N | 1338 | NGUAGACACGCAAAAUCUU | 1588 | UUUUGCGUGUCUACN' |
| F11-89N | 1339 | NUGAGUUUUCUCCAGAAUC | 1589 | CUGGAGAAAACUCAN' |
| F11-90N | 1340 | NAUUUCUUUGAGAUUCUUU | 1590 | AAUCUCAAAGAAAUN' |
| F11-91N | 1341 | NUAUAAGAAAAUCAUCCUG | 1591 | AUGAUUUUCUUAUAN' |
| F11-92N | 1342 | NAAAAUCUUAGGUGACUCU | 1592 | UCACCUAAGAUUUUN' |
| F11-93N | 1343 | NACACUGGGAUGCUGUGCC | 1593 | CAGCAUCCCAGUGUN' |
| F11-94N | 1344 | NUGCACAGGAUUUCAGUGA | 1594 | UGAAAUCCUGUGCAN' |
| F11-95N | 1345 | NAUACAAGCCAGAUUAGAA | 1595 | AAUCUGGCUUGUAUN' |
| F11-96N | 1346 | NUGUGGUUUCCAGUUUCAA | 1596 | AACUGGAAACCACAN' |
| F11-97N | 1347 | NUGCCCUUCCCUUCGUUGC | 1597 | CGAAGGGAAGGGCAN' |
| F11-98N | 1348 | NAAAAUCAUCCUGAAAAGA | 1598 | UUCAGGAUGAUUUUN' |
| F11-99N | 1349 | NCCAAGAAAUCAGUGUCAU | 1599 | CACUGAUUUCUUGGN' |
| F11-100N | 1350 | NGGCAUAUGGGUCGUUGAG | 1600 | ACGACCCAUAUGCCN' |

TABLE 1d-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-101N | 1351 | NAGAAUCUGUGUAAUUCAC | 1601 | AUUACACAGAUUCUN' |
| F11-102N | 1352 | NAUCCAGUCCACGUACUCG | 1602 | UACGUGGACUGGAUN' |
| F11-103N | 1353 | NCCUCUGUAUCUCUUCUGG | 1603 | AAGAGAUACAGAGGN' |
| F11-104N | 1354 | NGCACAGGAUUUCAGUGAA | 1604 | CUGAAAUCCUGUGCN' |
| F11-105N | 1355 | NGUAAAAUGAAGAAUGGCA | 1605 | AUUCUUCAUUUUACN' |
| F11-106N | 1356 | NGUCGUUGAGAAUCUGUGU | 1606 | AGAUUCUCAACGACN' |
| F11-107N | 1357 | NGCAACAAUAUCCAGUUCU | 1607 | CUGGAUAUUGUUGCN' |
| F11-108N | 1358 | NCAGCGGACGGCAUUGGUG | 1608 | AAUGCCGUCCGCUGN' |
| F11-109N | 1359 | NGAAAGCUUUAAGUAACAC | 1609 | UACUUAAAGCUUUCN' |
| F11-110N | 1360 | NGCAGUGUUUCUGUAACAC | 1610 | UACAGAAACACUGCN' |
| F11-111N | 1361 | NGAGAAUCUGUGUAAUUCA | 1611 | UUACACAGAUUCUCN' |
| F11-112N | 1362 | NUCCAGUCCACGUACUCGA | 1612 | GUACGUGGACUGGAN' |
| F11-113N | 1363 | NUGUGAGCAUUGCUUGAAA | 1613 | AAGCAAUGCUCACAN' |
| F11-114N | 1364 | NCCGGGAUGAUGAGUGCAG | 1614 | ACUCAUCAUCCCGGN' |
| F11-115N | 1365 | NCCACUUUAUCGAGCUUCG | 1615 | GCUCGAUAAAGUGGN' |
| F11-116N | 1366 | NCAUUAUCCAUUUUACACA | 1616 | UAAAAUGGAUAAUGN' |
| F11-117N | 1367 | NAACCGGGAUGAUGAGUGC | 1617 | UCAUCAUCCCGGUUN' |
| F11-118N | 1368 | NUUCUUUGGGCCAUUCCUG | 1618 | AAUGGCCCAAAGAAN' |
| F11-119N | 1369 | NCUAAGGGUAUCUUGGCUU | 1619 | CAAGAUACCCUUAGN' |
| F11-120N | 1370 | NUUGGUGUGAGCAUUGCUU | 1620 | AAUGCUCACACCAAN' |
| F11-121N | 1371 | NCAUAUGGGUCGUUGAGAA | 1621 | CAACGACCCAUAUGN' |
| F11-122N | 1372 | NUUAAUGUGUAUCCAGAGA | 1622 | UGGAUACACAUUAAN' |
| F11-123N | 1373 | NUCAGAUGUUUUAAGGAGA | 1623 | CUUAAAACAUCUGAN' |
| F11-124N | 1374 | NUUCCAAUGAUGGAGCCUC | 1624 | CUCCAUCAUUGGAAN' |
| F11-125N | 1375 | NAGAAUCCAGUCCACGUAC | 1625 | GUGGACUGGAUUCUN' |

TABLE 1d-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-126N | 1376 | NUUUGAGAUUCUUUGGGCC | 1626 | CAAAGAAUCUCAAAN' |
| F11-127N | 1377 | NAAUCAUCCUGAAAAGACC | 1627 | UUUUCAGGAUGAUUN' |
| F11-128N | 1378 | NAGACACGCAAAAUCUUAG | 1628 | GAUUUUGCGUGUCUN' |
| F11-129N | 1379 | NCGUACUCGACCACGUUGG | 1629 | CGUGGUCGAGUACGN' |
| F11-130N | 1380 | NCAUCCAGUCACCCAGCAA | 1630 | UGGGUGACUGGAUGN' |
| F11-131N | 1381 | NAACACUGGGAUGCUGUGC | 1631 | AGCAUCCCAGUGUUN' |
| F11-132N | 1382 | NCAGAAAGAGCUUUGCUCU | 1632 | CAAAGCUCUUUCUGN' |
| F11-133N | 1383 | NUUCUUUGAGAUUCUUUGG | 1633 | AGAAUCUCAAAGAAN' |
| F11-134N | 1384 | NAGCAACAAUAUCCAGUUC | 1634 | UGGAUAUUGUUGCUN' |
| F11-135N | 1385 | NACCACUUUAUCGAGCUUC | 1635 | CUCGAUAAAGUGGUN' |
| F11-136N | 1386 | NCCCUUCCCUUCGUUGCAG | 1636 | AACGAAGGGAAGGGN' |
| F11-137N | 1387 | NCGCAAAAUCUUAGGUGAC | 1637 | CCUAAGAUUUUGCGN' |
| F11-138N | 1388 | NAGCGUGUUACUGUGGAGG | 1638 | CACAGUAACACGCUN' |
| F11-139N | 1389 | NCUCCUUCCCUGUAGCCGG | 1639 | CUACAGGGAAGGAGN' |
| F11-140N | 1390 | NGUCCUCUGUAUCUCUUCU | 1640 | GAGAUACAGAGGACN' |
| F11-141N | 1391 | NGUAUCUUGGCUUUCUGGA | 1641 | GAAAGCCAAGAUACN' |
| F11-142N | 1392 | NCUCUUGGCAGUGUUUCUG | 1642 | AACACUGCCAAGAGN' |
| F11-143N | 1393 | NGAAAUCAGUGUCAUGGUA | 1643 | AUGACACUGAUUUCN' |
| F11-144N | 1394 | NCUUCCCUGUAGCCGGCAC | 1644 | CGGCUACAGGGAAGN' |
| F11-145N | 1395 | NCUGGCCGCUCCCUUUGAG | 1645 | AAGGGAGCGGCCAGN' |
| F11-146N | 1396 | NCACGCAAAAUCUUAGGUG | 1646 | UAAGAUUUUGCGUGN' |
| F11-147N | 1397 | NGAAACCAGAAAGAGCUUU | 1647 | CUCUUUCUGGUUUCN' |
| F11-148N | 1398 | NAAAGCUUUAAGUAACACU | 1648 | UUACUUAAAGCUUUN' |
| F11-149N | 1399 | NACAAGCCAGAUUAGAAAG | 1649 | CUAAUCGGCUUGUN' |
| F11-150N | 1400 | NACUCAUUAUCCAUUUUAC | 1650 | AAUGGAUAAUGAGUN' |

TABLE 1d-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-151N | 1401 | NCCUGAAAAGACCUUGUUG | 1651 | AAGGUCUUUUCAGGN' |
| F11-152N | 1402 | NGGUUUCCAAUGAUGGAGC | 1652 | CAUCAUUGGAAACCN' |
| F11-153N | 1403 | NCAGUUUCUGGCAGGCCUC | 1653 | CCUGCCAGAAACUGN' |
| F11-154N | 1404 | NAUGGCAGAACACUGGGAU | 1654 | CAGUGUUCUGCCAUN' |
| F11-155N | 1405 | NAGAUUUCUUUGAGAUUCU | 1655 | UCUCAAAGAAAUCUN' |
| F11-156N | 1406 | NGUUUCCAGUUUCAACAAG | 1656 | UUGAAACUGGAAACN' |
| F11-157N | 1407 | NUCCUCUGUAUCUCUUCUG | 1657 | AGAGAUACAGAGGAN' |
| F11-158N | 1408 | NCAUCCUGAAAAGACCUUG | 1658 | GUCUUUUCAGGAUGN' |
| F11-159N | 1409 | NUUGAGUUUUCUCCAGAAU | 1659 | UGGAGAAAACUCAAN' |
| F11-160N | 1410 | NAAUUCACUGUGGUUUCCA | 1660 | AACCACAGUGAAUUN' |
| F11-161N | 1411 | NAAGAUUUCUUUGAGAUUC | 1661 | CUCAAAGAAAUCUUN' |
| F11-162N | 1412 | NGGAGACAAAGAUUUCUUU | 1662 | AAAUCUUUGUCUCCN' |
| F11-163N | 1413 | NGAAAAUCAUCCUGAAAAG | 1663 | UCAGGAUGAUUUUCN' |
| F11-164N | 1414 | NCUUUCUGCCAUUUUAUAC | 1664 | AAAAUGGCAGAAAGN' |
| F11-165N | 1415 | NAGUCCACGUACUCGACCA | 1665 | CGAGUACGUGGACUN' |
| F11-166N | 1416 | NUUAAUGCGUGUACUGGGC | 1666 | AGUACACGCAUUAAN' |
| F11-167N | 1417 | NUAAUGUGUAUCCAGAGAU | 1667 | CUGGAUACACAUUAN' |
| F11-168N | 1418 | NGAUUCUUUGGGCCAUUCC | 1668 | UGGCCCAAAGAAUCN' |
| F11-169N | 1419 | NUGAAACCAGAAAGAGCUU | 1669 | UCUUUCUGGUUUCAN' |
| F11-170N | 1420 | NCACACAUUCACCAGAAAC | 1670 | CUGGUGAAUGUGUGN' |
| F11-171N | 1421 | NACAAAGAUUUCUUUGAGA | 1671 | AAAGAAAUCUUUGUN' |
| F11-172N | 1422 | NCAUUCUAUCUCCUUUGG | 1672 | AGGAGAUAGAAUGN' |
| F11-173N | 1423 | NUUUCUGUAACACUGUCUU | 1673 | CAGUGUUACAGAAAN' |
| F11-174N | 1424 | NGGAUUUCAGUGAAAAUCC | 1674 | UUUCACUGAAAUCCN' |
| F11-175N | 1425 | NCGCUCCCUUUGAGCACAG | 1675 | GCUCAAAGGGAGCGN' |

TABLE 1d-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-176N | 1426 | NCAGUCCACGUACUCGACC | 1676 | GAGUACGUGGACUGN' |
| F11-177N | 1427 | NAGGCAUAUGGGUCGUUGA | 1677 | CGACCCAUAUGCCUN' |
| F11-178N | 1428 | NAUGUCCUCUGUAUCUCUU | 1678 | GAUACAGAGGACAUN' |
| F11-179N | 1429 | NGCUUGAUUUUGGUGGUAC | 1679 | CACCAAAAUCAAGCN' |
| F11-180N | 1430 | NAUGAUGGAGCCUCCACAC | 1680 | GGAGGCUCCAUCAUN' |
| F11-181N | 1431 | NUCGUUGAGAAUCUGUGUA | 1681 | CAGAUUCUCAACGAN' |
| F11-182N | 1432 | NUUAUCCAUUUUACACAAC | 1682 | UGUAAAAUGGAUAAN' |
| F11-183N | 1433 | NUGUCCUAUUCACUCUUGG | 1683 | GAGUGAAUAGGACAN' |
| F11-184N | 1434 | NCAAUAUCCAGUUCUUCUC | 1684 | AGAACUGGAUAUUGN' |
| F11-185N | 1435 | NCUUUGAGAUUCUUUGGGC | 1685 | AAAGAAUCUCAAAGN' |
| F11-186N | 1436 | NCACUCUUGGCAGUGUUUC | 1686 | CACUGCCAAGAGUGN' |
| F11-187N | 1437 | NCUUGAAAGAAUACCCAGA | 1687 | GGUAUUCUUUCAAGN' |
| F11-188N | 1438 | NAGGCAAUAUCAUACCCGC | 1688 | GUAUGAUAUUGCCUN' |
| F11-189N | 1439 | NCUGUGUAAUUCACUGUGG | 1689 | AGUGAAUUACACAGN' |
| F11-190N | 1440 | NAAUAUCCACUGGUUUCCA | 1690 | AACCAGUGGAUAUUN' |
| F11-191N | 1441 | NUGAAAGAAUACCCAGAAA | 1691 | UGGGUAUUCUUUCAN' |
| F11-192N | 1442 | NGUUAAUAUCCACUGGUUU | 1692 | CAGUGGAUAUUAACN' |
| F11-193N | 1443 | NUGUCAUGGUAAAAUGAAG | 1693 | AUUUUACCAUGACAN' |
| F11-194N | 1444 | NAUUCUUUGGGCCAUUCCU | 1694 | AUGGCCCAAAGAAUN' |
| F11-195N | 1445 | NCAGUUCCUCCAACGAUCC | 1695 | CGUUGGAGGAACUGN' |
| F11-196N | 1446 | NGGGUGUGCUUCAGUAGAC | 1696 | ACUGAAGCACACCCN' |
| F11-197N | 1447 | NGAAGAAAGCUUUAAGUAA | 1697 | UUAAAGCUUUCUUCN' |
| F11-198N | 1448 | NAUCCUGAAAAGACCUUGU | 1698 | GGUCUUUUCAGGAUN' |
| F11-199N | 1449 | NAGAAAGCUUUAAGUAACA | 1699 | ACUUAAAGCUUUCUN' |
| F11-200N | 1450 | NCAGUGUUUCUGUAACACU | 1700 | UUACAGAAACACUGN' |

TABLE 1d-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-201N | 1451 | NGACACGCAAAAUCUUAGG | 1701 | AGAUUUUGCGUGUCN' |
| F11-202N | 1452 | NGUGUGAGCAUUGCUUGAA | 1702 | AGCAAUGCUCACACN' |
| F11-203N | 1453 | NACCAGAAAGAGCUUUGCU | 1703 | AAGCUCUUUCUGGUN' |
| F11-204N | 1454 | NAGAAAGUGCACAGGAUUU | 1704 | CCUGUGCACUUUCUN' |
| F11-205N | 1455 | NUUUAUUUCAGAUUGAUUU | 1705 | CAAUCUGAAAUAAAN' |
| F11-206N | 1456 | NUAUCCAGUUCUUCUCCCA | 1706 | AGAAGAACUGGAUAN' |
| F11-207N | 1457 | NCCGUGAAAGUGAAGAGUA | 1707 | CUUCACUUUCACGGN' |
| F11-208N | 1458 | NGGUGUGCUUCAGUAGACA | 1708 | UACUGAAGCACACCN' |
| F11-209N | 1459 | NGGACAGAGGGCCUCCCGA | 1709 | GAGGCCCUCUGUCCN' |
| F11-210N | 1460 | NAAGAAAAUCAUCCUGAAA | 1710 | AGGAUGAUUUCUUN' |
| F11-211N | 1461 | NUGAGAUUCUUUGGGCCAU | 1711 | CCCAAAGAAUCUCAN' |
| F11-212N | 1462 | NAUGUUUUAAGGAGACAAA | 1712 | UCUCCUUAAAACAUN' |
| F11-213N | 1463 | NCACAGUUUCUGGCAGGCC | 1713 | UGCCAGAAACUGUGN' |
| F11-214N | 1464 | NACAAUAUCCAGUUCUUCU | 1714 | GAACUGGAUAUUGUN' |
| F11-215N | 1465 | NACAUUCACCAGAAACUGA | 1715 | UUUCUGGUGAAUGUN' |
| F11-216N | 1466 | NCAAGGCAAUAUCAUACCC | 1716 | AUGAUAUUGCCUUGN' |
| F11-217N | 1467 | NCUCCAACGAUCCUGGGCU | 1717 | CAGGAUCGUUGGAGN' |
| F11-218N | 1468 | NCUGAAACCAGAAAGAGCU | 1718 | CUUUCUGGUUUCAGN' |
| F11-219N | 1469 | NAAUCUCCCUUGCAAGCGU | 1719 | UUGCAAGGGAGAUUN' |
| F11-220N | 1470 | NUGUGUAAUUCACUGUGGU | 1720 | CAGUGAAUUACACAN' |
| F11-221N | 1471 | NUUUCAGUGAAAAUCCAGA | 1721 | GAUUUUCACUGAAAN' |
| F11-222N | 1472 | NAAAUCAUCCUGAAAAGAC | 1722 | UUUCAGGAUGAUUUN' |
| F11-223N | 1473 | NUACACUCAUUAUCCAUUU | 1723 | GGAUAAUGAGUGUAN' |
| F11-224N | 1474 | NUUGGCAGUGUUUCUGUAA | 1724 | AGAAACACUGCCAAN' |
| F11-225N | 1475 | NGGUACACUCAUUAUCCAU | 1725 | AUAAUGAGUGUACCN' |

TABLE 1d-continued

Summary sequence table for active nucleobase sequences:

| Oligo Name | Seq ID No | Antisense (Guide) Strand Sequence (5' to 3') | Seq ID No | Sense (Passenger) Strand Sequence (5' to 3') |
|---|---|---|---|---|
| F11-226N | 1476 | NAGGCAGGCAUAUGGGUCG | 1726 | CCAUAUGCCUGCCUN' |
| F11-227N | 1477 | NCCAGUUUCAACAAGGCAA | 1727 | CUUGUUGAAACUGGN' |
| F11-228N | 1478 | NUGGCCGCUCCCUUUGAGC | 1728 | AAAGGGAGCGGCCAN' |
| F11-229N | 1479 | NACUGUGGUUUCCAGUUUC | 1729 | CUGGAAACCACAGUN' |
| F11-230N | 1480 | NCUUUGGGCCAUUCCUGGG | 1730 | GGAAUGGCCCAAAGN' |
| F11-231N | 1481 | NUAAGAAAAUCAUCCUGAA | 1731 | GGAUGAUUUUCUUAN' |
| F11-232N | 1482 | NCUCUUUUAUUUCAGAUUG | 1732 | CUGAAAUAAAAGAGN' |
| F11-233N | 1483 | NUCUUUGAGAUUCUUUGGG | 1733 | AAGAAUCUCAAAGAN' |
| F11-234N | 1484 | NAAUGAUGGAGCCUCCACA | 1734 | GAGGCUCCAUCAUUN' |
| F11-235N | 1485 | NGAAGAAUGGCAGAACACU | 1735 | UUCUGCCAUUCUUCN' |
| F11-236N | 1486 | NCAAUGAUGGAGCCUCCAC | 1736 | AGGCUCCAUCAUUGN' |
| F11-237N | 1487 | NAUGGAGCCUCCACACAGG | 1737 | UGUGGAGGCUCCAUN' |
| F11-238N | 1488 | NCCCAAGAAAUCAGUGUCA | 1738 | ACUGAUUUCUUGGGN' |
| F11-239N | 1489 | NGAGCCUCCACACAGGUGU | 1739 | CUGUGUGGAGGCUCN' |
| F11-240N | 1490 | NCUCCCAAGAAAUCAGUGU | 1740 | UGAUUUCUUGGGAGN' |
| F11-241N | 1491 | NCCUCCACACAGGUGUCUC | 1741 | CACCUGUGUGGAGGN' |
| F11-242N | 1492 | NCCAAUGAUGGAGCCUCCA | 1742 | GGCUCCAUCAUUGGN' |
| F11-243N | 1493 | NUUUCCAAUGAUGGAGCCU | 1743 | UCCAUCAUUGGAAAN' |
| F11-244N | 1494 | NUCCCAAGAAAUCAGUGUC | 1744 | CUGAUUUCUUGGGAN' |
| F11-245N | 1495 | NAGCCUCCACACAGGUGUC | 1745 | CCUGUGUGGAGGCUN' |
| F11-246N | 1496 | NUCUUCUCCCAAGAAAUCA | 1746 | UUCUUGGGAGAAGAN' |
| F11-247N | 1497 | NGUUUCCAAUGAUGGAGCC | 1747 | CCAUCAUUGGAAACN' |
| F11-248N | 1498 | NUCCAAUGAUGGAGCCUCC | 1748 | GCUCCAUCAUUGGAN' |
| F11-249N | 1499 | NUGGAGCCUCCACACAGGU | 1749 | GUGUGGAGGCUCCAN' |
| F11-250N | 1500 | NGCCUCCACACAGGUGUCU | 1750 | ACCUGUGUGGAGGCN' |

In above Table 1d:
A represents adenine;
U represents uracil;
C represents cytosine;
G represents guanine;
N represents any RNA nucleobase;
N' represents any RNA nucleobase and is preferably complementary to N.

TABLE 1e

Summary sequence table for active nucleobase sequences with chemical modifications:

| Oligo Name | construct No | Antisense (Guide) Strand Sequence (5' to 3') | construct No | Sense (Passenger) Strand Sequence (5' to 3') |
|---|---|---|---|---|
| F11-01NM | 1751 | PmN.fC.mA.fA.mA.fA.mU.fC.mU.fU.mA.fG.mG.fU.mG.fA.mC.fU.mC | 2001 | fC.mA.fC.mC.fU.mA.fA.mG.fA.mU.fU.mU.fU.mG.fN' |
| F11-02NM | 1752 | PmN.fA.mU.fU.mG.fA.mU.fU.mU.fA.mA.fA.mA.fU.mG.fC.mC.fA.mC | 2002 | fC.mA.fU.mU.fU.mU.fA.mA.fA.mU.fC.mA.fA.mU.fN' |
| F11-03NM | 1753 | PmN.fA.mA.fA.mA.fA.mU.fC.mG.fC.mU.fG.mC.fU.mG.fU.mC.fC.mU | 2003 | fC.mA.fG.mC.fA.mG.fC.mG.fA.mU.fU.mU.fC.mU.fN' |
| F11-04NM | 1754 | PmN.fA.mU.fA.mA.fG.mA.fA.mA.fA.mU.fC.mA.fU.mC.fC.mU.fG.mA | 2004 | fG.mA.fU.mG.fA.mU.fU.mU.fU.mC.fU.mU.fA.mU.fN' |
| F11-05NM | 1755 | PmN.fA.mA.fA.mC.fA.mC.fC.mG.fU.mA.fU.mU.fA.mG.fG.mA.fA.mA | 2005 | fC.mU.fA.mA.fU.mA.fC.mG.fG.mU.fG.mU.fU.mU.fN' |
| F11-06NM | 1756 | PmN.fA.mA.fA.mU.fC.mA.fG.mU.fG.mU.fC.mA.fU.mG.fG.mU.fA.mA | 2006 | fC.mA.fU.mG.fA.mC.fA.mC.fU.mG.fA.mU.fU.mU.fN' |
| F11-07NM | 1757 | PmN.fA.mU.fA.mC.fC.mC.fG.mC.fU.mU.fU.mC.fU.mG.fC.mC.fA.mU | 2007 | fC.mA.fG.mA.fA.mA.fG.mC.fG.mG.fG.mU.fA.mU.fN' |
| F11-08NM | 1758 | PmN.fA.mG.fA.mU.fG.mU.fU.mU.fU.mA.fA.mG.fG.mA.fG.mA.fC.mA | 2008 | fU.mC.fC.mU.fU.mA.fA.mA.fA.mC.fA.mU.fC.mU.fN' |
| F11-09NM | 1759 | PmN.fG.mG.fU.mA.fU.mC.fU.mU.fG.mG.fC.mU.fU.mU.fC.mU.fG.mG | 2009 | fA.mA.fA.mG.fC.mC.fA.mA.fG.mA.fU.mA.fC.mC.fN' |
| F11-10NM | 1760 | PmN.fC.mU.fC.mU.fG.mU.fA.mU.fC.mU.fC.mU.fU.mC.fU.mG.fG.mC | 2010 | fG.mA.fA.mG.fA.mG.fA.mU.fA.mC.fA.mG.fA.mG.fN' |
| F11-11NM | 1761 | PmN.fA.mU.fG.mG.fA.mU.fU.mA.fU.mU.fA.mU.fU.mU.fC.mU.fU.mG | 2011 | fA.mA.fA.mU.fA.mA.fU.mA.fA.mU.fC.mC.fA.mU.fN' |
| F11-12NM | 1762 | PmN.fA.mG.fC.mC.fA.mG.fA.mU.fU.mA.fG.mA.fA.mA.fG.mU.fG.mC | 2012 | fU.mU.fU.mC.fU.mA.fA.mU.fC.mU.fG.mG.fC.mU.fN' |
| F11-13NM | 1763 | PmN.fA.mG.fC.mG.fG.mA.fC.mG.fG.mC.fA.mU.fU.mG.fG.mU.fG.mC | 2013 | fC.mA.fA.mU.fG.mC.fC.mG.fU.mC.fG.mG.fC.mU.fN' |
| F11-14NM | 1764 | PmN.fA.mU.fU.mU.fC.mA.fG.mA.fU.mU.fG.mA.fU.mU.fU.mA.fA.mA | 2014 | fA.mA.fU.mC.fA.mA.fU.mC.fU.mG.fA.mA.fA.mU.fA | 
| F11-15NM | 1765 | PmN.fU.mU.fG.mU.fC.mU.fC.mU.fU.mA.fG.mU.fU.mUc.fU.mC.fU.mG | 2015 | fA.mA.fA.mA.fU.mA.fA.mG.fA.mG.fA.mC.fA.mA.fN' |
| F11-16NM | 1766 | PmN.fA.mG.fA.mA.fC.mA.fC.mU.fG.mG.fG.mA.fU.mG.fC.mU.fG.mU | 2016 | fC.mA.fU.mC.fC.mC.fA.mG.fU.mG.fU.mU.fC.mU.fN' |
| F11-17NM | 1767 | PmN.fC.mC.fA.mC.fU.mU.fG.mA.fU.mA.fU.mA.fA.mG.fA.mA.fA.mA | 2017 | fC.mU.fU.mA.fU.mA.fU.mC.fA.mA.fG.mU.fG.mG.fN' |
| F11-18NM | 1768 | PmN.fC.mA.fU.mU.fU.mU.fC.mU.fU.mA.fC.mA.fA.mA.fC.mA.fC.mC | 2018 | fU.mU.fU.mG.fU.mA.fA.mG.fA.mA.fA.mA.fU.mG.fN' |
| F11-19NM | 1769 | PmN.fU.mA.fA.mU.fG.mC.fG.mU.fG.mU.fA.mU.fC.mU.fG.mG.fC.mA | 2019 | fC.mA.fG.mU.fA.mC.fA.mC.fG.mC.fA.mU.fU.mA.fN' |
| F11-20NM | 1770 | PmN.fA.mG.fG.mA.fC.mA.fG.mA.fG.mG.fG.mC.fC.mU.fC.mC.fC.mG | 2020 | fA.mG.fG.mC.fC.mC.fU.mC.fU.mG.fU.mC.fC.mU.fN' |
| F11-21NM | 1771 | PmN.fC.mA.fA.mC.fC.mG.fG.mG.fA.mU.mG.fA.mG.fA.mG.fU.mG | 2021 | fC.mA.fU.mC.fA.mU.fC.mC.fC.mG.fG.mU.fU.mG.fN' |
| F11-22NM | 1772 | PmN.fG.mA.fC.mA.fA.mA.fG.mA.fU.mU.fU.mC.fU.mU.fU.mG.fA.mG | 2022 | fA.mA.fG.mA.fA.mA.fU.mC.fU.mU.fU.mG.fU.mC.fN' |
| F11-23NM | 1773 | PmN.fG.mA.fG.mG.fA.mA.fG.mC.fA.mU.fG.mC.fU.mG.fG.mC.fA.mC | 2023 | fC.mA.fG.mC.fA.mU.fG.mC.fU.mU.fC.mC.fU.mC.fN' |
| F11-24NM | 1774 | PmN.fG.mG.fA.mA.fA.mA.fU.mG.fU.mC.fC.mC.fU.mA.fA.mU.fA.mC | 2024 | fU.mA.fG.mG.fG.mA.fC.mA.fU.mU.fU.mU.fC.mC.fN' |
| F11-25NM | 1775 | PmN.fU.mU.fA.mA.fG.mU.fA.mA.fC.mA.fC.mU.fU.mG.fC.mC.fC.mU | 2025 | fC.mA.fA.mG.fU.mG.fU.mU.fA.mC.fU.mU.fA.mA.fN' |
| F11-26NM | 1776 | PmN.fC.mA.fA.mU.fA.mU.fC.mA.fU.mA.fC.mC.fC.mG.fC.mU.fU.mU | 2026 | fC.mG.fG.mG.fU.mA.fU.mG.fA.mU.fA.mU.fU.mG.fN' |
| F11-27NM | 1777 | PmN.fA.mA.fA.mU.fG.mU.fA.mC.fC.mA.fC.mU.fU.mG.fA.mU.fA.mU | 2027 | fC.mA.fA.mG.fU.mG.fG.mU.fA.mC.fA.mU.fU.mU.fN' |
| F11-28NM | 1778 | PmN.fA.mG.fA.mA.fA.mA.fU.mC.fA.mU.fC.mC.fU.mG.fA.mA.fA.mA | 2028 | fC.mA.fG.mG.fA.mU.fG.mA.fU.mU.fU.mU.fC.mU.fN' |
| F11-29NM | 1779 | PmN.fU.mA.fA.mC.fA.mC.fU.mU.fG.mC.fC.mC.fU.mU.fC.mC.fC.mU | 2029 | fA.mA.fG.mG.fG.mC.fA.mA.fG.mU.fG.mU.fmA.fN' |
| F11-30NM | 1780 | PmN.fA.mG.fC.mA.fU.mU.fU.mU.fC.mU.fU.mA.fC.mA.fA.mA.fC.mA | 2030 | fU.mG.fU.mA.fA.mG.fA.mA.fA.mA.fU.mG.fC.mU.fN' |
| F11-31NM | 1781 | PmN.fC.mA.fA.mA.fC.mA.fC.mC.fG.mU.fA.mU.fU.mA.fG.mG.fA.mA | 2031 | fU.mU.fA.mU.fA.mC.fG.mG.fU.mG.fU.mU.fU.mG.fN' |
| F11-32NM | 1782 | PmN.fA.mG.fC.mG.fG.mC.fU.mG.fU.mU.fA.mA.fU.mA.fU.mC.fC.mA | 2032 | fU.mA.fU.mU.fA.mA.fC.mA.fG.mC.fC.mG.fC.mU.fN' |
| F11-33NM | 1783 | PmN.fG.mA.fG.mC.fG.mG.fC.mU.fG.mU.fU.mA.fA.mU.fA.mU.fC.mC | 2033 | fA.mU.fU.mA.fA.mC.fA.mG.fC.mC.fG.mC.fU.mC.fN' |
| F11-34NM | 1784 | PmN.fG.mA.fG.mA.fC.mA.fA.mA.fG.mA.fU.mU.fU.mC.fU.mU.fU.mG | 2034 | fG.mA.fA.mA.fU.mC.fU.mU.fU.mG.fU.mC.fU.mC.fN' |

TABLE 1e-continued

Summary sequence table for active nucleobase sequences with chemical modifications:

| Oligo Name | construct No | Antisense (Guide) Strand Sequence (5' to 3') | construct No | Sense (Passenger) Strand Sequence (5' to 3') |
|---|---|---|---|---|
| F11-35NM | 1785 | PmN.fU.mG.fG.mG.fU.mU.fA.mU.fU.mU.fU.mA.fU.mG.fU.mC.fC.mU | 2035 | fC.mA.fU.mA.fA.mA.fA.mU.fA.mA.fC.mC.fC.mA.fN' |
| F11-36NM | 1786 | PmN.fG.mA.fG.mC.fC.mA.fU.mG.fA.mC.fA.mC.fU.mG.fU.mC.fG.mA | 2036 | fC.mA.fG.mU.fG.mU.fC.mA.fU.mG.fG.mC.fU.mC.fN' |
| F11-37NM | 1787 | PmN.fC.mA.fG.mA.fU.mU.fA.mG.fA.mA.fA.mG.fU.mG.fC.mA.fC.mA | 2037 | fC.mA.fC.mU.fU.mU.fC.mU.fA.mA.fU.mC.fU.mG.fN' |
| F11-38NM | 1788 | PmN.fA.mG.fA.mA.fU.mA.fC.mC.fC.mA.fG.mA.fA.mU.fC.mC.fG.mA | 2038 | fU.mU.fU.mC.fU.mG.fG.mG.fU.mA.fU.mU.fC.mU.fN' |
| F11-39NM | 1789 | PmN.fC.mA.fG.mA.fU.mG.fU.mU.fU.mU.fA.mA.fG.mG.fA.mG.fA.mC | 2039 | fC.mC.fU.mU.fA.mA.fA.mA.fC.mA.fU.mC.fU.mG.fN' |
| F11-40NM | 1790 | PmN.fU.mG.fU.mA.fU.mC.fC.mA.fG.mA.fG.mA.fU.mG.fC.mC.fU.mC | 2040 | fC.mA.fU.mC.fU.mC.fU.mG.fG.mA.fU.mA.fC.mA.fN' |
| F11-41NM | 1791 | PmN.fG.mA.fG.mU.fC.mA.fC.mA.fC.mA.fU.mU.fC.mA.fC.mC.fA.mG | 2041 | fU.mG.fA.mA.fU.mG.fU.mG.fU.mG.fA.mC.fU.mC.fN' |
| F11-42NM | 1792 | PmN.fC.mA.fA.mA.fG.mA.fA.mA.fG.mA.fU.mG.fU.mU.fC.mC.fN.mU | 2042 | fC.mA.fC.mA.fU.mC.fU.mU.fU.mC.fU.mU.fU.mG.fN' |
| F11-43NM | 1793 | PmN.fA.mC.fC.mA.fC.mU.fU.mG.fA.mU.fA.mU.fA.mA.fG.mA.fA.mA | 2043 | fU.mU.fA.mU.fA.mU.fC.mA.fA.mG.fU.mG.fG.mU.fN' |
| F11-44NM | 1794 | PmN.fA.mA.fG.mA.fA.mA.fG.mC.fU.mU.fA.mA.fA.mG.fA.mA.fC | 2044 | fC.mU.fU.mU.fA.mA.fG.mC.fU.mU.fU.mC.fU.mU.fN' |
| F11-45NM | 1795 | PmN.fU.mU.fA.mU.fU.mU.fC.mA.fG.mA.fU.mU.fG.mA.fU.mU.fU.mA | 2045 | fU.mC.fA.mA.fU.mC.fU.mG.fA.mA.fA.mU.fA.mA.fN' |
| F11-46NM | 1796 | PmN.fU.mG.fG.mU.fG.mU.fG.mA.fG.mC.fA.mU.fC.mU.fU.mG | 2046 | fC.mA.fA.mU.fG.mC.fU.mC.fA.mC.fA.mC.fC.mA.fN' |
| F11-47NM | 1797 | PmN.fA.mU.fC.mA.fU.mC.fC.mU.fG.mA.fA.mA.fA.mG.fA.mC.fC.mU | 2047 | fC.mU.fU.mU.fU.mC.fA.mG.fG.mA.fU.mG.fA.mU.fN' |
| F11-48NM | 1798 | PmN.fG.mU.fG.mA.fG.mC.fA.mU.fU.mG.fC.mU.fU.mG.fA.mA.mG | 2048 | fC.mA.fA.mG.fC.mA.fA.mU.fG.mC.fU.mC.fN' |
| F11-49NM | 1799 | PmN.fC.mU.fG.mU.fA.mU.fC.mU.fC.mU.fU.mC.fU.mG.fG.mC.fA.mC | 2049 | TC.mA.fG.mA.fA.mG.fA.mG.fA.mU.fA.mC.fA.mG.fN' |
| F11-50NM | 1800 | PmN.fA.mC.fC.mU.fU.mA.fA.mU.fG.mU.fA.mU.fC.mC.fA.mG | 2050 | fA.mU.fA.mC.fA.mC.fA.mU.fU.mA.fA.mU.fU.mA.fN' |
| F11-51NM | 1801 | PmN.fA.mU.fC.mA.fU.mG.fA.mU.fU.mA.mU.fU.mU.fU.mC | 2051 | fU.mA.fA.mU.fA.mA.fU.mC.fC.mA.fU.mG.fA.mU.fN' |
| F11-52NM | 1802 | PmN.fC.mA.fA.mA.fG.mA.fU.mU.fU.mC.fU.mU.fU.mG.fA.mG.fA.mU | 2052 | fC.mA.fA.mA.fG.mA.fA.mA.fU.mC.fU.mU.fU.mG.fN' |
| F11-53NM | 1803 | PmN.fG.mA.fA.mA.fU.mA.fU.mU.fU.mU.fA.mG.fU.mU.fG.mA.fA.mG | 2053 | fA.mA.fC.mU.fA.mA.fA.mA.fU.mA.fC.mU.fU.mC.fN' |
| F11-54NM | 1804 | PmN.fA.mG.fA.mU.fU.mG.fA.mU.fU.mU.fA.mA.fA.mA.fU.mG.fC.mC | 2054 | fU.mU.fU.mU.fA.mA.fA.mU.fC.mA.fA.mU.fC.mU.fN' |
| F11-55NM | 1805 | PmN.fG.mG.fG.mU.fA.mU.fC.mU.fU.mG.fG.mC.fU.mU.fU.mC.fU.mG | 2055 | fA.mA.fG.mC.fC.mA.fA.mG.fA.mU.fA.mC.fC.mC.fN' |
| F11-56NM | 1806 | PmN.fA.mG.fG.mA.fG.mA.fC.mA.fA.mA.fG.mA.fU.mU.fU.mC.fU.mU | 2056 | fA.mA.fU.mC.fU.mU.fU.mG.fU.mC.fU.mC.fC.mU.fN' |
| F11-57NM | 1807 | PmN.fG.mU.fC.mA.fU.mG.fG.mU.fA.mA.fA.mA.fU.mG.fA.mA.fG.mA | 2057 | fC.mA.fU.mU.fU.mU.fA.mC.fC.mA.fU.mG.fA.mC.fN' |
| F11-58NM | 1808 | PmN.fA.mU.fA.mU.fC.mC.fA.mG.fU.mU.fC.mU.fU.mC.fU.mC.fC.mC | 2058 | fG.mA.fA.mG.fA.mA.fC.mU.fG.mG.fA.mU.fA.mU.fN' |
| F11-59NM | 1809 | PmN.fA.mA.fU.mA.fU.mC.fC.mA.fG.mU.fU.mC.fU.mU.fC.mC | 2059 | fA.mA.fG.mA.fA.mC.fU.mG.fG.mA.fU.mA.fU.mU.fN' |
| F11-60NM | 1810 | PmN.fC.mU.fG.mU.fG.mG.fU.mU.fU.mC.fC.mA.fG.mU.fU.mC.fA | 2060 | fA.mC.fU.mG.fG.mA.fA.mA.fC.mC.fA.mC.fA.mG.fN' |
| F11-61NM | 1811 | PmN.fA.mG.fA.mU.fU.mA.fG.mA.fA.mA.fG.mU.fG.mC.fA.mC.fA.mG | 2061 | fG.mC.fA.mC.fU.mU.fU.mC.fU.mA.fA.mU.fC.mU.fN' |
| F11-62NM | 1812 | PmN.fA.mG.fA.mA.fA.mU.fC.mA.fG.mU.fG.mU.fC.mA.fU.mG.fG.mU | 2062 | fU.mG.fA.mC.fA.mC.fU.mG.fA.mU.fU.mU.fC.mU.fN' |
| F11-63NM | 1813 | PmN.fU.mG.fG.mA.fU.mU.fA.mU.fU.mA.fU.mU.fC.mU.fU.mG.fG.mA | 2063 | fG.mA.fA.mU.fA.mA.fU.mA.fA.mU.fC.mC.fA.mN' |
| F11-64NM | 1814 | PmN.fC.mC.fA.mG.fA.mU.fU.mA.fG.mA.fA.mA.fG.mU.fG.mC.fA.mC | 2064 | fA.mC.fU.mU.fU.mC.fU.mA.fA.mU.fC.mU.fG.mG.fN' |
| F11-65NM | 1815 | PmN.fC.mU.fC.mA.fU.mU.fA.mU.fC.mC.fA.mU.fU.mU.fA.mU.fC.mA | 2065 | fA.mA.fA.mU.fG.mG.fA.mU.fA.mA.fU.mG.fA.mG.fN' |
| F11-66NM | 1816 | PmN.fU.mU.fG.mG.fG.mC.fC.mA.fU.mU.fC.mC.fU.mG.fG.mA | 2066 | fC.mA.fG.mG.fA.mA.fU.mG.fG.mC.fC.mC.fA.mA.fN' |
| F11-67NM | 1817 | PmN.fU.mG.fG.mG.f.mU.fU.mG.fA.mU.fU.mU.fU.mG.fG.mU.fG.mG | 2067 | fC.mA.fA.mA.fA.mU.fC.mA.fA.mG.fC.mC.fC.mA.fN' |
| F11-68NM | 1818 | PmN.fC.mA.fG.mA.fU.mU.fG.mA.fU.mU.fA.mU.fA.mA.fU.mC | 2068 | fU.mU.fU.mA.fA.mU.fA.mU.fC.mA.fA.mU.fC.mU.fN' |
| F11-69NM | 1819 | PmN.fA.mA.fG.mC.fA.mA.fC.mC.fG.mG.fG.mA.fU.mG.fA.mU.fG.mA | 2069 | fC.mA.fU.mC.fC.mC.fG.mG.fU.mU.fG.mC.fU.mU.fN' |
| F11-70NM | 1820 | PmN.fC.mU.fU.mA.fA.mU.fG.mU.fG.mU.fA.mU.fC.mC.fA.mG.fA.mG | 2070 | fG.mG.fA.mU.fA.mC.fA.mC.fA.mU.fU.mA.fA.mG.fN' |
| F11-71NM | 1821 | PmN.fG.mU.fA.mA.fU.mU.fC.mA.fC.mU.fG.mU.fG.mG.fU.mU.fU.mC | 2071 | fC.mC.fA.mC.fA.mG.fU.mG.fA.mA.fU.mU.fA.mC.fN' |

TABLE 1e-continued

Summary sequence table for active nucleobase sequences with chemical modifications:

| Oligo Name | construct No | Antisense (Guide) Strand Sequence (5' to 3') | construct No | Sense (Passenger) Strand Sequence (5' to 3') |
|---|---|---|---|---|
| F11-72NM | 1822 | PmN.fA.mC.fA.mU.fU.mU.fC.mU.fA.mU.fC.mU.fC.mC.fU.mU.fU.mG | 2072 | fG.mG.fA.mG.fA.mU.fA.mG.fA.mA.fA.mU.fG.mU.fN' |
| F11-73NM | 1823 | PmN.fC.mA.fC.mU.fG.mG.fU.mU.fU.mC.fC.mA.fA.mU.fG.mA.fU.mG | 2073 | fA.mU.fU.mG.fG.mA.fA.mA.fC.mC.fA.mG.fU.mG.fN' |
| F11-74NM | 1824 | PmN.fG.mA.fA.mU.fC.mU.fG.mU.fG.mU.fA.mA.fU.mU.fC.mA.fC.mU | 2074 | fA.mA.fU.mU.fA.mC.fA.mC.fA.mG.fA.mU.fU.mC.fN' |
| F11-75NM | 1825 | PmN.fG.mU.fC.mC.fU.mA.fU.mU.fC.mA.fC.mC.fU.mU.fU.mG.fG.mC | 2075 | fA.mG.fA.mG.fU.mG.fA.mA.fU.mA.fG.mG.fA.mC.fN' |
| F11-76NM | 1826 | PmN.fA.mG.fC.mA.fU.mU.fG.mC.fU.mU.fG.mA.fA.mA.fG.mA.fA.mU | 2076 | fU.mU.fU.mC.fA.mA.fG.mC.fA.mA.fU.mG.fC.mU.fN' |
| F11-77NM | 1827 | PmN.fA.mA.fU.mA.fC.mC.fC.mA.fG.mA.fA.mA.fU.mC.fG.mC.fU.mG | 2077 | fG.mA.fU.mU.fU.mC.fU.mG.fG.mG.fU.mA.fU.mU.fN' |
| F11-78NM | 1828 | PmN.fA.mU.fU.mA.fU.mU.fA.mU.fU.mU.fC.mU.fU.mG.fA.mA.fC.mC | 2078 | fC.mA.fA.mG.fA.mA.fA.mU.fA.mA.fU.mA.fA.mU.fN' |
| F11-79NM | 1829 | PmN.fA.mA.fG.mU.fA.mU.fU.mU.fU.mA.fG.mU.fU.mG.fG.mA.fG.mA | 2079 | fC.mA.fA.mC.fU.mA.fA.mA.fA.mU.fA.mC.fU.mU.fN' |
| F11-80NM | 1830 | PmN.fG.mA.fA.mU.fC.mC.fA.mG.fU.mC.fC.mA.fC.mG.fU.mA.fC.mU | 2080 | fC.mG.fU.mG.fG.mA.fC.mU.fG.mG.fA.mU.fU.mC.fN' |
| F11-81NM | 1831 | PmN.fA.mG.fA.mC.fA.mA.fA.mG.fA.mU.fU.mU.fU.mU.fG.mA | 2081 | fA.mG.fA.mA.fA.mU.fC.mU.fU.mU.fG.mU.fC.mU.fN' |
| F11-82NM | 1832 | PmN.fA.mC.fA.mG.fG.mA.fU.mU.fU.mC.fA.mG.fU.mG.fA.mA.fA.mA | 2082 | fC.mC.fU.mG.fA.mA.fU.mC.fC.mU.fG.mU.fN' |
| F11-83NM | 1833 | PmN.fA.mA.fC.mA.fA.mG.fG.mC.fA.mA.fU.mU.fA.mU.fA.mC | 2083 | fG.mA.fU.mA.fU.mU.fG.mC.fC.mU.fU.mG.fU.mU.fN' |
| F11-84NM | 1834 | PmN.fA.mA.fG.mG.fC.mA.fA.mU.fA.mU.fC.mA.fU.mA.fC.mC.fC.mG | 2084 | fU.mA.fU.mG.fA.mU.fA.mU.fU.mG.fC.mC.fU.mU.fN' |
| F11-85NM | 1835 | PmN.fA.mU.fA.mC.fC.mC.fA.mG.fA.mA.fA.mU.fC.mG.fC.mU.fG.mC | 2085 | fC.mG.fA.mU.fU.mU.fC.mU.fG.mG.fG.mU.fA.mU.fN' |
| F11-86NM | 1836 | PmN.fG.mA.fU.mU.fG.mA.fU.mU.fU.mA.fA.mA.fA.mU.fG.mC.fC.mA | 2086 | fA.mU.fU.mU.fU.mA.fA.mA.fU.mC.fA.mA.fU.mC.fN' |
| F11-87NM | 1837 | PmN.fC.mC.fU.mA.fU.mU.fC.mA.fC.mC.fU.mU.fU.mG.fG.mC.fA.mG | 2087 | fC.mA.fA.mG.fA.mG.fU.mG.fA.mA.fU.mA.fG.mG.fN' |
| F11-88NM | 1838 | PmN.fG.mU.fA.mG.fA.mC.fA.mC.fG.mC.fA.mA.fA.mA.fU.mC.fU.mU | 2088 | fU.mU.fU.mU.fG.mC.fG.mU.fG.mU.fC.mU.fA.mC.fN' |
| F11-89NM | 1839 | PmN.fU.mG.fA.mG.fU.mU.fU.mU.fC.mU.fC.mC.fA.mG.fA.mA.fU.mC | 2089 | fC.mU.fG.mG.fA.mG.fA.mA.fA.mA.fC.mU.fC.mA.fN' |
| F11-90NM | 1840 | PmN.fA.mU.fU.mU.fC.mU.fU.mU.fG.mA.fG.mA.fU.mU.fC.mU.fU.mU | 2090 | fA.mA.fG.mA.fA.mU.fC.mU.fC.mA.fA.mA.fG.fA.mA.fA.mU.fN' |
| F11-91NM | 1841 | PmN.fU.mA.fU.mA.fA.mG.fA.mA.fA.mA.fU.mC.fA.mU.fC.mC.fU.mG | 2091 | fA.mU.fG.mA.fU.mU.fU.mU.fC.mU.fU.mA.fU.mA.fN' |
| F11-92NM | 1842 | PmN.fA.mA.fA.mA.fA.mU.fC.mU.fU.mA.fA.mG.fG.mU.fG.mA.fC.mU | 2092 | fU.mC.fA.mC.fC.mU.fU.mA.fA.mG.fU.mU.fU.mU.fN' |
| F11-93NM | 1843 | PmN.fA.mC.fA.mC.fU.mG.fG.mG.fA.mU.fG.mC.fU.mG.fU.mG.fC.mC | 2093 | fC.mA.fG.mC.fA.mU.fC.mC.fC.mA.fG.mU.fG.mU.fN' |
| F11-94NM | 1844 | PmN.fU.mG.fC.mA.fC.mA.fG.mG.fA.mU.fU.mU.fC.mA.fG.mU.fG.mA | 2094 | fU.mG.fA.mA.fA.mU.fC.mC.fU.mG.fU.mG.fC.mA.fN' |
| F11-95NM | 1845 | PmN.fA.mU.fA.mC.fA.mA.fG.mC.fC.mA.fG.mA.fU.mU.fA.mG.fA.mA | 2095 | fA.mA.fU.mC.fU.mG.fG.mC.fU.mU.fG.mU.fA.mU.fN' |
| F11-96NM | 1846 | PmN.fU.mG.fU.mG.fG.mU.fU.mU.fC.mC.fA.mG.fU.mU.fU.mC.fA.mA | 2096 | fA.mA.fC.mU.fG.mG.fA.mA.fA.mC.fC.mA.fC.mA.fN' |
| F11-97NM | 1847 | PmN.fU.mG.fC.mC.fC.mU.fU.mC.fC.mC.fU.mU.fC.mG.fU.mU.fG.mC | 8207 | fC.mG.fA.mA.fG.mG.fG.mA.fA.mG.fG.mG.fC.mA.fN' |
| F11-98NM | 1848 | PmN.fA.mA.fA.mA.fU.mC.fA.mU.fC.mC.fU.mG.fA.mA.fA.mA.fG.mA | 2098 | fU.mU.fC.mA.fG.mG.fA.mU.fG.mA.fU.mU.fU.mU.fN' |
| F11-99NM | 1849 | PmN.fC.mC.fA.mA.fG.mA.fA.mA.fU.mC.fA.mG.fU.mG.fU.mC.fA.mU | 2099 | fC.mA.fC.mU.fG.mA.fU.mU.fU.mC.fU.mU.fG.mG.fN' |
| F11-100NM | 1850 | PmN.fG.mG.fC.mA.fU.mA.fU.mG.fG.mG.fU.mC.fG.mU.mG.fA.mG | 2100 | fA.mC.fG.mA.fC.mC.fC.mA.fU.mA.fU.mG.fC.mC.fN' |
| F11-101NM | 1851 | PmN.fA.mG.fA.mA.fU.mC.fU.mG.fU.mG.fU.mA.fA.mU.fU.mC.fA.mC | 2101 | fA.mU.fA.mC.fA.mC.fA.mG.fA.mU.fU.mC.fU.mU.fN' |
| F11-102NM | 1852 | PmN.fA.mU.fC.mC.fA.mG.fU.mC.fC.mA.fC.mG.fU.mA.fC.mU.fC.mG | 2102 | fU.mA.fC.mG.fU.mG.fG.mA.fC.mU.fG.mG.fA.mU.fN' |
| F11-103NM | 1853 | PmN.fC.mC.fU.mC.fU.mG.fU.mA.fU.mC.fU.mC.fU.mU.fC.mU.fG.mG | 2103 | fA.mA.fG.mA.fG.mA.fU.mA.fC.mA.fG.mA.fG.mG.fN' |
| F11-104NM | 1854 | PmN.fG.mC.fA.mC.fA.mG.fG.mA.fU.mU.fU.mC.fA.mG.fU.mG.fA.mA | 2104 | fC.mU.fG.mA.fA.mA.fU.mC.fC.mU.fG.mU.fG.mC.fN' |
| F11-105NM | 1855 | PmN.fG.mU.fA.mA.fA.mA.fU.mG.fA.mG.mA.fA.mG.mG.fC.mA | 2105 | fA.mU.fU.mC.fU.mU.fC.mA.fU.mU.fU.mU.fA.mC.fN' |
| F11-106NM | 1856 | PmN.fG.mU.fC.mG.fU.mU.fG.mA.fG.mA.fA.mU.fC.mU.fG.mU.fG.mU | 2106 | fA.mG.fA.mU.fU.mC.fU.mC.fA.mA.fC.mG.fA.mC.fN' |
| F11-107NM | 1857 | PmN.fG.mC.fA.mA.fC.mA.fA.mU.fA.mU.fC.mC.fA.mG.fU.mU.fC.mU | 2107 | fC.mU.fG.mG.fA.mU.fA.mU.fU.mG.fU.mU.fG.mC.fN' |
| F11-108NM | 1858 | PmN.fC.mA.fG.mC.fG.mG.fA.mC.fG.mG.fC.mA.fU.mU.fG.mG.fU.mG | 2108 | fA.mA.fU.mG.fC.mC.fG.mU.fC.mC.fG.mC.fU.mG.fN' |

TABLE 1e-continued

Summary sequence table for active nucleobase sequences with chemical modifications:

| Oligo Name | construct No | Antisense (Guide) Strand Sequence (5' to 3') | construct No | Sense (Passenger) Strand Sequence (5' to 3') |
|---|---|---|---|---|
| F11-109NM | 1859 | PmN.fG.mA.fA.mA.fG.mC.fU.mU.fU.mA.fA.mG.fU.mA.fA.mC.fA.mC | 2109 | fU.mA.fC.mU.fU.mA.fA.mA.fG.mC.fU.mU.fU.mC.fN' |
| F11-110NM | 1860 | PmN.fG.mC.fA.mG.fU.mG.fU.mU.fU.mC.fG.mU.fU.mA.fA.mC.fA.mC | 2110 | fU.mA.fC.mA.fG.mA.fA.mA.fC.mA.fC.mU.fG.mC.fN' |
| F11-111NM | 1861 | PmN.fG.mA.fG.mA.fA.mU.fC.mU.fG.mU.fG.mU.fA.mA.fU.mU.fC.mA | 2111 | fU.mU.fA.mC.fA.mC.fA.mG.fA.mU.fU.mC.fU.mC.fN' |
| F11-112NM | 1862 | PmN.fU.mC.fC.mA.fG.mU.fC.mC.fA.mC.fG.mU.fA.mC.fU.mC.fG.mA | 2112 | fG.mU.fA.mC.fG.mU.fG.mG.fA.mC.fU.mG.fG.mA.fN' |
| F11-113NM | 1863 | PmN.fU.mG.fU.mG.fA.mG.fC.mA.fU.mU.fG.mC.fU.mU.fG.mA.fA.mA | 2113 | fA.mA.fG.mC.fA.mA.fU.mG.fC.mU.fC.mA.fC.mA.fN' |
| F11-114NM | 1864 | PmN.fC.mC.fG.mG.fG.mA.fU.mG.fA.mU.fG.mA.fG.mU.fG.mC.fA.mG | 2114 | fA.mC.fU.mC.fA.mU.fC.mA.fU.mC.fC.mC.fG.mG.fN' |
| F11-115NM | 1865 | PmN.fC.mC.fA.mC.fU.mU.fU.mA.fU.mC.fG.mA.fG.mC.fU.mU.fC.mG | 2115 | fG.mC.fU.mC.fG.mA.fU.mA.fA.mA.fG.mU.fG.mG.fN' |
| F11-116NM | 1866 | PmN.fC.mA.fU.mU.fA.mU.fC.mC.fA.mU.mU.fU.mA.fC.mA.fC.mA | 2116 | fU.mA.fA.mA.fA.mU.fG.mG.fA.mU.fA.mA.fU.mG.fN' |
| F11-117NM | 1867 | PmN.fA.mA.fC.mC.fG.mG.fG.mA.fU.mG.fA.mU.fG.mA.fG.mU.fG.mC | 2117 | fU.mC.fA.mU.fC.mA.fU.mC.fC.mC.fG.mG.fU.mU.fN' |
| F11-118NM | 1868 | PmN.fU.mU.fC.mU.fU.mU.fG.mG.fG.mC.fC.mA.fU.mU.fC.mC.fU.mG | 2118 | fA.mA.fU.mG.fG.mC.fC.mC.fA.mA.fA.mA.fN' |
| F11-119NM | 1869 | PmN.fC.mU.fA.mA.fG.mG.fG.mU.fA.mU.fC.mU.fU.mG.fG.mC.fU.mU | 2119 | fC.mA.fA.mG.fA.mU.fA.mC.fC.mC.fU.mU.fA.mG.fN' |
| F11-120NM | 1870 | PmN.fU.mU.fG.mG.fU.mG.fU.mG.fA.mG.fC.mA.fU.mU.fG.mC.fU.mU | 2120 | fA.mA.fU.mG.fC.mU.fC.mA.fC.mA.fC.mA.fN' |
| F11-121NM | 1871 | PmN.fC.mA.fU.mA.fU.mG.fG.mG.fU.mC.fG.mU.fU.mG.fA.mG.fA.mA | 2121 | fC.mA.fC.mG.fA.mC.fC.mC.fA.mU.fA.mU.fG.mG.fN' |
| F11-122NM | 1872 | PmN.fU.mU.fA.mA.fU.mG.fU.mG.fU.mA.fU.mC.fC.mA.fG.mA.fG.mA | 2122 | fU.mG.fG.mA.fU.mA.fC.mA.fC.mA.fU.mU.fA.mA.fN' |
| F11-123NM | 1873 | PmN.fU.mC.fA.mG.fA.mU.fG.mU.fU.mU.fU.mA.fA.mG.fG.mA.fA.mA | 2123 | fC.mU.fU.mA.fA.mA.fA.mC.fA.mU.fC.mU.fG.mA.fN' |
| F11-124NM | 1874 | PmN.fU.mU.fC.mC.fA.mA.fU.mG.fA.mU.fG.mG.fA.mC.fC.mC.fU.mC | 2124 | fC.mU.fC.mC.fA.mU.fC.mA.fU.mU.fG.mG.fA.mA.fN' |
| F11-125NM | 1875 | PmN.fA.mG.fA.mA.fU.mC.fC.mA.fG.mU.fC.mC.fA.mC.fG.mU.fA.mC | 2125 | fG.mU.fG.mG.fA.mC.fU.mG.fG.mA.fU.mU.fC.mU.fN' |
| F11-126NM | 1876 | PmN.fU.mU.fU.mG.fA.mG.fA.mU.fU.mC.fU.mU.fU.mG.fG.mG.fC.mC | 2126 | fC.mA.fA.mA.fG.mA.fA.mU.fC.mU.fC.mA.fA.mA.fN' |
| F11-127NM | 1877 | PmN.fA.mA.fU.mC.fA.mU.fC.mC.fU.mG.fA.mA.fA.mA.fG.mA.fC.mC | 2127 | fU.mU.fU.mU.fC.mA.fG.mG.fA.mU.fG.mA.fU.mU.fN' |
| F11-128NM | 1878 | PmN.fA.mG.fA.mC.fA.mC.fG.mC.fA.mA.fA.mA.fU.mC.fU.mU.fA.mG | 2128 | fG.mA.fU.mU.fU.mU.fG.mC.fG.mU.fG.mU.fC.mU.fN' |
| F11-129NM | 1879 | PmN.fC.mC.fG.mU.fA.mC.fU.mC.fC.mG.fA.mC.fC.mA.fC.mG.fU.mG | 2129 | fC.mG.fU.mG.fG.mU.fC.mG.fG.mA.fG.mU.fA.mC.fG.mG.fN' |
| F11-130NM | 1880 | PmN.fC.mA.fU.mC.fC.mA.fG.mU.fC.mA.fC.mC.fC.mA.fG.mC.fA.mA | 2130 | fU.mG.fG.mG.fU.mG.fA.mC.fU.mG.fG.mA.fU.mG.fN' |
| F11-131NM | 1881 | PmN.fA.mA.fC.mA.fC.mU.fG.mG.fG.mA.fU.mG.fC.mU.fG.mU.fG.mC | 2131 | fA.mG.fC.mA.fC.mC.fC.mA.fG.mU.fG.mU.fU.mC.fN' |
| F11-132NM | 1882 | PmN.fC.mA.fG.mA.fA.mA.fG.mA.fG.mC.fU.mU.fU.mG.fC.mU.fC.mU | 2132 | fC.mA.fA.mA.fG.mC.fU.mC.fU.mU.fU.mC.fU.mG.fN' |
| F11-133NM | 1883 | PmN.fU.mU.fC.mU.fU.mU.fG.mA.fG.mA.fU.mU.fC.mU.fU.mU.fG.mG | 2133 | fA.mG.fA.mA.fU.mC.fU.mC.fA.mA.fA.mG.fA.mA.fN' |
| F11-134NM | 1884 | PmN.fA.mG.fC.mA.fA.mC.fA.mA.fU.mA.fU.mC.fC.mA.fG.mU.fU.mC | 2134 | fU.mG.fG.mA.fU.mA.fU.mU.fG.mU.fU.mG.fC.mU.fN' |
| F11-135NM | 1885 | PmN.fA.mC.fC.mA.fU.mU.fA.mU.fC.mA.fG.mC.fU.mU.fC | 2135 | fC.mU.fC.mG.fA.mU.fA.mA.fA.mG.fU.mG.fN' |
| F11-136NM | 1886 | PmN.fC.mC.fC.mU.fU.mC.fC.mC.fU.mU.fC.mG.fU.mU.fG.mC.fA.mG | 2136 | fA.mA.fC.mG.fA.mA.fG.mG.fG.mA.fA.mG.fG.mG.fN' |
| F11-137NM | 1887 | PmN.fC.mG.fC.mA.fA.mA.fA.mU.fC.mU.fU.mA.fG.mG.fU.mG.fA.mC | 2137 | fC.mC.fU.mA.fA.mG.fA.mU.fU.mU.fU.mG.fC.mG.fN' |
| F11-138NM | 1888 | PmN.fA.mG.fC.mG.fU.mG.fU.mU.fA.mC.fU.mG.fU.mG.fG.mA.fG.mG | 2138 | fC.mC.fA.mC.fA.mG.fU.mA.fA.mC.fA.mC.fG.mC.fU.mU.fN' |
| F11-139NM | 1889 | PmN.fC.mU.fC.mC.fU.mU.fC.mC.fC.mU.fG.mU.fA.mG.fC.mC.fG.mG | 2139 | fC.mU.fA.mC.fA.mG.fG.mG.fA.mA.fG.mG.fA.mG.fN' |
| F11-140NM | 1890 | PmN.fG.mU.fC.mC.fU.mU.fC.mU.fU.mG.fU.mA.fU.mC.fU.mU.fC.mU | 2140 | fG.mA.fG.mA.fU.mA.fC.mA.fA.mG.fA.mA.fG.mG.fA.mC.fN' |
| F11-141NM | 1891 | PmN.fG.mU.fA.mU.fC.mU.fU.mG.fG.mC.fU.mU.fU.mC.fU.mG.fG.mA | 2141 | fG.mA.fA.mA.fG.mC.fC.mA.fA.mG.fA.mU.fA.mC.fN' |
| F11-142NM | 1892 | PmN.fC.mU.fC.mU.fU.mG.fG.mC.fA.mG.fU.mU.fU.mU.fU.mC.fU.mG | 2142 | fA.mA.fC.mU.fG.mC.fC.mA.fA.mG.fA.mC.fN' |
| F11-143NM | 1893 | PmN.fG.mA.fA.mA.fU.mC.fA.mG.fU.mG.fU.mC.fA.mU.fG.mG.fU.mA | 2143 | fA.mC.fA.mC.fA.mC.fU.mG.fA.mU.fU.mU.fC.fN' |
| F11-144NM | 1894 | PmN.fC.mU.fU.mC.fC.mC.fU.mG.fU.mA.fG.mC.fC.mG.fG.mC.fA.mC | 2144 | fC.mG.fG.mC.fU.mA.fC.mA.fG.mG.fG.mA.fA.mG.fN' |
| F11-145NM | 1895 | PmN.fC.mU.fG.mG.fC.mC.fG.mC.fU.mC.fC.mC.fU.mU.fU.mG.fA.mG | 2145 | fA.mA.fG.mG.fG.mA.fG.mC.fG.mG.fC.mC.fA.mG.fN' |

TABLE 1e-continued

Summary sequence table for active nucleobase sequences with chemical modifications:

| Oligo Name | construct No | Antisense (Guide) Strand Sequence (5' to 3') | construct No | Sense (Passenger) Strand Sequence (5' to 3') |
|---|---|---|---|---|
| F11-146NM | 1896 | PmN.fC.mA.fC.mG.fC.mA.fA.mA.fA.mU.fC.mU.fU.mA.fG.mG.fU.mG | 2146 | fU.mA.fA.mG.fA.mU.fU.mU.fU.mG.fC.mG.fU.mG.fN' |
| F11-147NM | 1897 | PmN.fG.mA.fA.mA.fC.mC.fA.mG.fA.mA.fA.mG.fA.mG.fC.mU.fU.mU | 2147 | fC.mU.fC.mU.fU.mU.fC.mU.fG.mG.fU.mU.fU.mC.fN' |
| F11-148NM | 1898 | PmN.fA.mA.fA.mG.fC.mU.fU.mU.fA.mA.fG.mU.fA.mA.fC.mA.fC.mU | 2148 | fU.mU.fA.mC.fU.mU.fA.mA.fA.mG.fC.mU.fU.mU.fN' |
| F11-149NM | 1899 | PmN.fA.mC.fA.mA.fG.mC.fC.mA.fG.mA.fU.mU.fA.mG.fA.mA.fA.mG | 2149 | fC.mU.fA.mA.fU.mC.fU.mG.fG.mC.fU.mU.fG.mU.fN' |
| F11-150NM | 1900 | PmN.fA.mC.fU.mC.fA.mU.fU.mA.fU.mC.fC.mA.fU.mU.fU.mU.fA.mC | 2150 | fA.mA.fU.mG.fG.mA.fU.mA.fA.mU.fG.mA.fG.mU.fN' |
| F11-151NM | 1901 | PmN.fC.mC.fU.mG.fA.mA.fA.mA.fG.mA.fC.mC.fU.mU.fG.mU.fU.mG | 2151 | fA.mA.fG.mG.fU.mC.fU.mU.fU.mU.fC.mA.fG.mG.fN' |
| F11-152NM | 1902 | PmN.fG.mG.fU.mU.fU.mC.fC.mA.fA.mU.fG.mA.fU.mG.fG.mA.fG.mC | 2152 | fC.mA.fU.mC.fA.mU.fU.mG.fG.mA.fA.mA.fC.mC.fN' |
| F11-153NM | 1903 | PmN.fC.mA.fG.mU.fU.mU.fC.mU.fG.mG.fC.mA.fG.mG.fC.mC.fU.mC | 2153 | fC.mC.fU.mG.fC.mC.fA.mG.fA.mA.fA.mC.fU.mG.fN' |
| F11-154NM | 1904 | PmN.fA.mU.fG.mG.fC.mA.fG.mA.fA.mC.fA.mC.fU.mG.fG.mG.fA.mU | 2154 | fC.mA.fG.mU.fG.mU.fU.mC.fU.mG.fC.mC.fA.mU.fN' |
| F11-155NM | 1905 | PmN.fA.mG.fA.mU.fU.mU.fC.mU.fU.mU.fG.mA.fG.mA.fU.mU.fC.mU | 2155 | fU.mC.fU.mC.fA.mA.fA.mG.fA.mA.fA.mU.fC.mU.fN' |
| F11-156NM | 1906 | PmN.fG.mU.fU.mU.fC.mC.fA.mG.fU.mU.fU.mC.fA.mA.fC.mA.fA.mG | 2156 | fU.mU.fG.mA.fA.mA.fC.mU.fG.mG.fA.mA.fA.mC.fN' |
| F11-157NM | 1907 | PmN.fU.mC.fC.mU.fC.mU.fG.mU.fA.mU.fC.mU.fC.mU.fU.mC.fU.mG | 2157 | fA.mG.fA.mG.fA.mU.fA.mC.fA.mG.fA.mG.fG.mA.fN' |
| F11-158NM | 1908 | PmN.fC.mA.fU.mC.fC.mU.fG.mA.fA.mA.fA.mG.fA.mC.fC.mU.fU.mG | 2158 | fG.mU.fC.mU.fU.mU.fU.mC.fA.mG.fG.mA.fU.mG.fN' |
| F11-159NM | 1909 | PmN.fU.mU.fG.mA.fG.mU.fU.mU.fU.mC.fU.mC.fC.mA.fG.mA.fA.mU | 2159 | fU.mG.fG.mA.fG.mA.fA.mA.fA.mC.fU.mC.fA.mA.fN' |
| F11-160NM | 1910 | PmN.fA.mA.fU.mU.fC.mA.fC.mU.fG.mU.fG.mG.fU.mU.fU.mC.fC.mA | 2160 | fA.mA.fC.mC.fA.mC.fA.mG.fU.mG.fA.mA.fU.mU.fN' |
| F11-161NM | 1911 | PmN.fA.mA.fG.mA.fU.mU.fU.mC.fU.mU.fU.mG.fA.mG.fA.mU.fU.mC | 2161 | fC.mU.fC.mA.fA.mA.fG.mA.fA.mA.fU.mC.fU.mU.fN' |
| F11-162NM | 1912 | PmN.fG.mG.fA.mG.fA.mC.fA.mA.fA.mG.fA.mU.fU.mU.fC.mU.fU.mU | 2162 | fA.mA.fA.mU.fC.mU.fU.mU.fG.mU.fC.mU.fC.mC.fN' |
| F11-163NM | 1913 | PmN.fG.mA.fA.mA.fA.mU.fC.mA.fU.mC.fC.mU.fG.mA.fA.mA.fA.mG | 2163 | fU.mC.fA.mG.fG.mA.fU.mG.fA.mU.fU.mU.fU.mC.fN' |
| F11-164NM | 1914 | PmN.fC.mU.fU.mU.fC.mU.fG.mC.fC.mA.fU.mU.fU.mU.fA.mU.fA.mC | 2164 | fA.mA.fA.mA.fU.mG.fG.mC.fA.mG.fA.mA.fA.mG.fN' |
| F11-165NM | 1915 | PmN.fA.mG.fU.mC.fC.mA.fC.mG.fU.mA.fC.mU.fC.mG.fA.mC.fC.mA | 2165 | fC.mG.fA.mG.fU.mA.fC.mG.fU.mG.fG.mA.fC.mU.fN' |
| F11-166NM | 1916 | PmN.fU.mU.fA.mA.fU.mG.fC.mG.fU.mG.fU.mA.fC.mU.fG.mG.fG.mC | 2166 | fA.mG.fU.mA.fC.mA.fC.mG.fC.mA.fU.mU.fA.mA.fN' |
| F11-167NM | 1917 | PmN.fU.mA.fA.mU.fG.mU.fG.mU.fA.mU.fC.mC.fA.mG.fA.mG.fA.mU | 2167 | fC.mU.fG.mG.fA.mU.fA.mC.fA.mC.fA.mU.fU.mA.fN' |
| F11-168NM | 1918 | PmN.fG.mA.fU.mU.fC.mU.fU.mU.fG.mG.fG.mC.fC.mA.fU.mU.fC.mC | 2168 | fU.mG.fG.mC.fC.mC.fA.mA.fA.mG.fA.mA.fU.mC.fN' |
| F11-169NM | 1919 | PmN.fU.mG.fA.mA.fA.mC.fC.mA.fG.mA.fA.mA.fG.mA.fG.mC.fU.mU | 2169 | fU.mC.fU.mU.fU.mC.fU.mG.fG.mU.fU.mU.fC.mA.fN' |
| F11-170NM | 1920 | PmN.fC.mA.fC.mA.fC.mA.fU.mU.fC.mA.fC.mC.fA.mG.fA.mA.fA.mC | 2170 | fC.mU.fG.mG.fU.mG.fA.mA.fU.mG.fU.mG.fU.mG.fN' |
| F11-171NM | 1921 | PmN.fA.mC.fA.mA.fA.mG.fA.mU.fU.mU.fC.mU.fU.mU.fG.mA.fG.mA | 2171 | fA.mA.fA.mG.fA.mA.fA.mU.fC.mU.fU.mU.fG.mU.fN' |
| F11-172NM | 1922 | PmN.fC.mA.fU.mU.fU.mC.fC.mU.fA.mA.fU.mC.fU.mC.fC.mU.fU.mU.fG.mG | 2172 | fA.mG.fG.mA.fG.mA.fU.mA.fG.mA.fA.mA.fU.mG.fN' |
| F11-173NM | 1923 | PmN.fU.mU.fU.mC.fU.mG.fU.mA.fA.mC.fA.mC.fU.mG.fU.mC.fU.mU | 2173 | fC.mA.fG.mU.fG.mU.fU.mA.fC.mA.fG.mA.fA.mA.fN' |
| F11-174NM | 1924 | PmN.fG.mG.fA.mU.fU.mU.fC.mA.fG.mU.fG.mA.fA.mA.fA.mU.fC.mC | 2174 | fU.mU.fU.mC.fA.mC.fU.mG.fA.mA.fA.mU.fC.mC.fN' |
| F11-175NM | 1925 | PmN.fC.mG.fC.mU.fC.mC.fC.mU.fU.mU.fG.mA.fG.mC.fA.mC.fA.Mg | 2175 | fG.mC.fU.mC.fA.mA.fA.mG.fG.mG.fA.mG.fC.mG.fN' |
| F11-176NM | 1926 | PmN.fC.mA.fG.mU.fC.mC.fA.mC.fG.mU.fA.mC.fUn.mC.fG.mA.fC.mC | 2176 | fG.mA.fG.mU.fA.mC.fG.mU.fG.mG.fA.mC.fU.mG.fN' |
| F11-177NM | 1927 | PmN.fA.mG.fG.mC.fA.mU.fA.mU.fG.mG.fG.mU.fC.mG.fU.mU.fG.mA | 2177 | fC.mG.fA.mC.fC.mC.fA.mU.fA.mU.fG.mC.fC.mU.fN' |
| F11-178NM | 1928 | PmN.fA.mU.fG.mU.fC.mC.fU.mC.fU.mG.fU.mA.fU.mC.fU.mC.fU.mU | 2178 | fG.mA.fU.mA.fC.mA.fG.mA.fG.mG.fA.mC.fA.mU.fN' |
| F11-179NM | 1929 | PmN.fG.mC.fU.mU.fG.mA.fU.mU.fU.mU.fG.mG.fU.mG.fG.mU.fA.mC | 2179 | fC.mA.fC.mC.fA.mA.fA.mA.fU.mC.fA.mA.fG.mC.fN' |
| F11-180NM | 1930 | PmN.fA.mU.fG.mA.fU.mG.fG.mA.fG.mC.fC.mU.fC.mC.fA.mC.fA.mC | 2180 | fG.mG.fA.mG.fG.mC.fU.mC.fC.mA.fU.mC.fA.mU.fN' |
| F11-181NM | 1931 | PmN.fU.mC.fG.mU.fU.mG.fA.mG.fA.mA.FU.mC.fU.mG.fU.mG.fU.mA | 2181 | fC.mA.fG.mA.fU.mU.fC.mU.fC.mA.fA.mC.fG.mA.fN' |
| F11-182NM | 1932 | PmN.fU.mU.fA.mU.fC.mC.fA.mU.fU.mU.fU.mA.fC.mA.fC.mA.fA.mC | 2182 | fU.mG.fU.mA.fA.mA.fA.mU.fG.mG.fA.mU.fA.mA.fN' |

TABLE 1e-continued

Summary sequence table for active nucleobase sequences with chemical modifications:

| Oligo Name | construct No | Antisense (Guide) Strand Sequence (5' to 3') | construct No | Sense (Passenger) Strand Sequence (5' to 3') |
|---|---|---|---|---|
| F11-183NM | 1933 | PmN.fU.mG.fU.mC.fC.mU.fA.mU.fU.mC.fA.mC.fU.mC.fU.mU.fG.mG | 2183 | fG.mA.fG.mU.fG.mA.fA.mU.fA.mG.fG.mA.fC.mA.fN' |
| F11-184NM | 1934 | PmN.fC.mA.fA.mU.fA.mU.fC.mC.fA.mG.fU.mU.fC.mU.fU.mC.fU.mC | 2184 | fA.mG.fA.mA.fC.mU.fG.mG.fA.mU.fA.mU.fU.mG.fN' |
| F11-185NM | 1935 | PmN.fC.mU.fU.mU.fG.mA.fG.mA.fU.mU.fC.mU.fU.mU.fG.mG.fG.mC | 2185 | fA.mA.fA.mG.fA.mA.fU.mC.fU.mC.fA.mA.fA.mG.fN' |
| F11-186NM | 1936 | PmN.fC.mA.fC.mU.fC.mU.fU.mG.fG.mC.fA.mG.fU.mG.fU.mU.fU.mC | 2186 | fC.mA.fC.mU.fG.mC.fC.mA.fA.mG.fA.mG.fU.mG.fN' |
| F11-187NM | 1937 | PmN.fC.mU.fU.mG.fA.mA.fA.mG.fA.mA.fU.mA.fC.mC.fC.mA.fG.mA | 2187 | fG.mG.fU.mA.fU.mU.fC.mU.fU.mU.fC.mA.fA.mG.fN' |
| F11-188NM | 1938 | PmN.fA.mG.fG.mC.fA.mA.fU.mA.fU.mC.fA.mU.fA.mC.fC.mC.fG.mC | 2188 | fG.mU.fA.mU.fG.mA.fU.mA.fU.mU.fG.mC.fC.mU.fN' |
| F11-189NM | 1939 | PmN.fC.mU.fG.mU.fG.mU.fA.mA.fU.mU.fC.mA.fC.mU.fG.mU.fG.mG | 2189 | fA.mG.fU.mG.fA.mA.fU.mU.fA.mC.fA.mC.fA.mG.fN' |
| F11-190NM | 1940 | PmN.fA.mA.fU.mA.fU.mC.fC.mA.fC.mU.fG.mG.fU.mU.fU.mC.fC.mA | 92190 | fA.mA.fC.mC.fA.mG.fU.mG.fG.mA.fU.mA.fU.mU.fN' |
| F11-191NM | 1941 | PmN.fU.mG.fA.mA.fA.mG.fA.mA.fU.mA.fC.mC.fC.mA.fG.mA.fA.mA | 2191 | fU.mG.fG.mG.fU.mA.fU.mU.fC.mU.fU.mU.fC.mA.fN' |
| F11-192NM | 1942 | PmN.fG.mU.fU.mA.fA.mU.fA.mU.fC.mC.fA.mC.fU.mG.fG.mU.fU.mU | 2192 | fC.mA.fG.mU.fG.mG.fA.mU.fA.mU.fU.mA.fA.mC.fN' |
| F11-193NM | 1943 | PmN.fU.mG.fU.mC.fA.mU.fG.mG.fU.mA.fA.mA.fA.mU.fG.mA.fA.mG | 2193 | fA.mU.fU.mU.fU.mA.fC.mC.fA.mU.fG.mA.fC.mA.fN' |
| F11-194NM | 1944 | PmN.fA.mU.fU.mC.fU.mU.fU.mG.fG.mG.fC.mC.fA.mU.fU.mC.fC.mU | 2194 | fA.mU.fG.mG.fC.mC.fC.mA.fA.mA.fG.mA.fA.mU.fN' |
| F11-195NM | 1945 | PmN.fC.mA.fG.mU.fU.mC.fC.mU.fC.mC.fA.mA.fC.mG.fA.mU.fC.mC | 2195 | fC.mG.fU.mU.fG.mG.fA.mG.fG.mA.fA.mG.fU.mG.fN' |
| F11-196NM | 1946 | PmN.fG.mG.fG.mU.fG.mU.fG.mC.fU.mU.fC.mA.fG.mU.fA.mG.fA.mC | 2196 | fA.mC.fU.mG.fA.mA.fG.mC.fA.mC.fA.mC.fC.mC.fN' |
| F11-197NM | 1947 | PmN.fG.mA.fA.mG.fA.mA.fA.mG.fC.mU.fU.mU.fA.mA.fG.mU.fA.mA | 2197 | fU.mU.fA.mA.fA.mG.fC.mU.fU.mU.fC.mU.fU.mC.fN' |
| F11-198NM | 1948 | PmN.fA.mU.fC.mC.fU.mG.fA.mA.fA.mA.fG.mA.fC.mC.fU.mU.fG.mU | 2198 | fG.mG.fU.mC.fU.mU.fU.mU.fC.mA.fG.mG.fA.mU.fN' |
| F11-199NM | 1949 | PmN.fA.mG.fA.mA.fA.mG.fC.mU.fU.mU.fA.mA.fG.mU.fA.mA.fC.mA | 2199 | fA.mC.fU.mU.fA.mA.fA.mG.fC.mU.fU.mU.fC.mU.fN' |
| F11-200NM | 1950 | PmN.fC.mA.fG.mU.fG.mU.fU.mU.fC.mU.fG.mU.fA.mA.fC.mA.fC.mU | 2200 | fU.mU.fA.mC.fA.mG.fA.mA.fA.mC.fA.mC.fU.mG.fN' |
| F11-201NM | 1951 | PmN.fG.mA.fC.mA.fC.mG.fC.mA.fA.mA.fA.mU.fC.mU.fU.mA.fG.mG | 2201 | fA.mG.fA.mU.fU.mU.fU.mG.fC.mG.fU.mG.fU.mC.fN' |
| F11-202NM | 1952 | PmN.fG.mU.fG.mU.fG.mA.fG.mC.fA.mU.fU.mG.fC.mU.fU.mG.fA.mA | 2202 | fA.mG.fC.mA.fA.mU.fG.mC.fU.mC.fA.mC.fA.mC.fN' |
| F11-203NM | 1953 | PmN.fA.mC.fC.mA.fG.mA.fA.mA.fG.mA.fG.mC.fU.mU.fU.mG.fC.mU | 2203 | fA.mA.fG.mC.fU.mC.fU.mU.fU.mC.fU.mG.fG.mU.fN' |
| F11-204NM | 1954 | PmN.fA.mG.fA.mA.fA.mG.fU.mG.fC.mA.fC.mA.fG.mG.fA.mU.fU.mU | 2204 | fC.mC.fU.mG.fU.mG.fC.mA.fC.mU.fU.mU.fC.mU.fN' |
| F11-205NM | 1955 | PmN.fU.mU.fU.mA.fU.mU.fU.mC.fA.mG.fA.mU.fU.mG.fA.mU.fU.mU | 2205 | fC.mA.fA.mU.fC.mU.fG.mA.fA.mA.fU.mA.fA.mA.fN' |
| F11-206NM | 1956 | PmN.fU.mA.fU.mC.fC.mA.fG.mU.fU.mC.fU.mU.fC.mU.fC.mC.fC.mA | 2206 | fA.mG.fA.mA.fG.mA.fA.mC.fU.mG.fG.mA.fU.mA.fN' |
| F11-207NM | 1957 | PmN.fC.mC.fG.mU.fG.mA.fA.mA.fG.mU.fG.mA.fA.mG.fA.mG.fU.mA | 2207 | fC.mU.fU.mC.fA.mC.fU.mU.fU.mC.fA.mC.fG.mG.fN' |
| F11-208NM | 1958 | PmN.fG.mG.fU.mG.fU.mG.fC.mU.fU.mC.fA.mG.fU.mA.fG.mA.fC.mA | 2208 | fU.mA.fC.mU.fG.mA.fA.mG.fC.mA.fC.mA.fC.mC.fN' |
| F11-209NM | 1959 | PmN.fG.mG.fA.mC.fA.mG.fA.mG.fG.mG.fC.mC.fU.mC.fC.mC.fG.mA | 2209 | fG.mA.fG.mG.fC.mC.fC.mU.fC.mU.fG.mU.fC.mC.fN' |
| F11-210NM | 1960 | PmN.fA.mA.fG.mA.fA.mA.fA.mU.fC.mA.fU.mC.fC.mU.fG.mA.fA.mA | 2210 | fA.mG.fG.mA.fU.mG.fA.mU.fU.mU.fU.mC.fU.mU.fN' |
| F11-211NM | 1961 | PmN.fU.mG.fA.mG.fA.mU.fU.mC.fU.mU.fU.mG.fG.mG.fC.mC.fA.mU | 2211 | fC.mC.fC.mA.fA.mA.fG.mA.fA.mU.fC.mU.fC.mA.fA.fN' |
| F11-212NM | 1962 | PmN.fA.mU.fG.mU.fU.mU.fU.mA.fA.mG.fG.mA.fG.mA.fC.mA.fA.mA | 2212 | fU.mC.fU.mC.fC.mU.fU.mA.fA.mA.fA.mC.fA.mU.fN' |
| F11-213NM | 1963 | PmN.fC.mA.fC.mA.fG.mU.fU.mU.fC.mU.fG.mG.fC.mA.fG.mG.fC.mC | 2213 | fU.mG.fC.mC.fA.mG.fA.mA.fA.mC.fU.mG.fU.mG.fN' |
| F11-214NM | 1964 | PmN.fA.mC.fA.mA.fU.mA.fU.mC.fC.mA.fG.mU.fU.mC.fU.mU.fC.mU | 2214 | fG.mA.fA.mC.fU.mG.fG.mA.fU.mA.fU.mU.fG.mU.fN' |
| F11-215NM | 1965 | PmN.fA.mC.fA.mU.fU.mC.fA.mC.fC.mA.G.mA.fA.mA.fC.mU.fG.mA | 2215 | fU.mU.fU.mC.fU.mG.fG.mU.fG.mA.fA.mU.fG.mU.fN' |
| F11-216NM | 1966 | PmN.fC.mA.fA.mG.fG.mC.fA.mA.fU.mA.fU.mC.fA.mU.fA.mC.fC.mC | 2216 | fA.mU.fG.mA.fU.mA.fU.mU.fG.mC.fC.mU.fU.mG.fN' |
| F11-217NM | 1967 | PmN.fC.mU.fC.mC.fA.mA.fC.mG.fA.mU.fC.mC.fU.mG.fG.mG.fC.mU | 2217 | fC.mA.fG.mG.fA.mU.fC.mG.fU.mU.fG.mG.fA.mG.fN' |
| F11-218NM | 1968 | PmN.fC.mU.fG.mA.fA.mA.fC.mC.fA.mG.fA.mA.fA.mG.fA.mG.fC.mU | 2218 | fC.mU.fU.mU.fC.mU.fG.mG.fU.mU.fU.mC.fA.mG.fN' |
| F11-219NM | 1969 | PmN.fA.mA.fU.mC.fU.mC.fC.mC.fU.mU.fG.mC.fA.mA.fG.mC.fG.mU | 2219 | fU.mU.fG.mC.fA.mA.fG.mG.fG.mA.fG.mA.fU.mU.fN' |

TABLE 1e-continued

Summary sequence table for active nucleobase sequences with chemical modifications:

| Oligo Name | construct No | Antisense (Guide) Strand Sequence (5' to 3') | construct No | Sense (Passenger) Strand Sequence (5' to 3') |
|---|---|---|---|---|
| F11-220NM | 1970 | PmN.fU.mG.fU.mG.fU.mA.fA.mU.fU.mC.fA.mC.fU.mG.fU.mG.fG.mU | 2220 | fC.mA.fG.mU.fG.mA.fA.mU.fU.mA.fC.mA.fC.mA.fN' |
| F11-221NM | 1971 | PmN.fU.mU.fU.mC.fA.mG.fU.mG.fA.mA.fA.mA.fU.mC.fC.mA.fG.mA | 2221 | fG.mA.fU.mU.fU.mU.fC.mA.fC.mU.fG.mA.fA.mA.fN' |
| F11-222NM | 1972 | PmN.fA.mA.fA.mU.fC.mA.fU.mC.fC.mU.fG.mA.fA.mA.fA.mG.fA.mC | 2222 | fU.mU.fU.mC.fA.mG.fG.mA.fU.mG.fA.mU.fU.mU.fN' |
| F11-223NM | 1973 | PmN.fU.mA.fC.mA.fC.mU.fC.mA.fU.mU.fA.mU.fC.mC.fA.mU.fU.mU | 2223 | fG.mG.fA.mU.fA.mA.fU.mG.fA.mG.fU.mG.fU.mA.fN' |
| F11-224NM | 1974 | PmN.fU.mU.fG.mG.fC.mA.fG.mU.fG.mU.fU.mU.fC.mU.fG.mU.fA.mA | 2224 | fA.mG.fA.mA.fA.mC.fA.mC.fU.mG.fC.mC.fA.mA.fN' |
| F11-225NM | 1975 | PmN.fG.mG.fU.mA.fC.mA.fC.mU.fC.mA.fU.mU.fA.mU.fC.mC.fA.mU | 2225 | fA.mU.fA.mA.fU.mG.fA.mG.fU.mG.fU.mA.fC.mC.fN' |
| F11-226NM | 1976 | PmN.fA.mG.fG.mC.fA.mG.fG.mC.fA.mU.fA.mU.fG.mG.fG.mU.fC.mG | 2226 | fC.mC.fA.mU.fA.mU.fG.mC.fC.mU.fG.mC.fC.mU.fN' |
| F11-227NM | 1977 | PmN.fC.mC.fA.mG.fU.mU.fU.mC.fA.mA.fC.mA.fA.mG.fC.mA.fA | 2227 | fC.mU.fU.mG.fU.mU.fG.mA.fA.mA.fC.mU.fG.mG.fN' |
| F11-228NM | 1978 | PmN.fU.mG.fG.mC.fC.mG.fC.mU.fC.mC.fC.mU.fU.mU.fG.mA.fG.mC | 2228 | fA.mA.fA.mG.fG.mA.fG.mC.fG.mC.fC.mA.fN' |
| F11-229NM | 1979 | PmN.fA.mC.fU.mG.fU.mG.fG.mU.fU.mU.mC.fA.mG.fU.mU.fU.mC | 2229 | fC.mU.fG.mG.fA.mA.fA.mA.fC.mC.fA.mC.fA.mG.fU.mC.fN' |
| F11-230NM | 1980 | PmN.fC.mU.fU.mU.fG.mG.fG.mC.fC.mA.fU.mU.fC.mC.fU.mG.fG.mG | 2230 | fG.mG.fA.mA.fU.mG.fG.mC.fC.mC.fA.mA.fA.mG.fN' |
| F11-231NM | 1981 | PmN.fU.mA.fA.mG.fA.mA.fA.mA.fU.mC.fA.mU.mC.fU.mG.fA.mA | 2231 | fG.mG.fA.mU.fG.mA.fU.mU.fU.mU.fC.mU.fU.mA.fN' |
| F11-232NM | 1982 | PmN.fC.mU.fC.mU.fU.mU.fU.mA.fU.mU.fU.mC.fA.mG.fA.mU.fU.mG | 2232 | fC.mU.fG.mA.fA.mA.fU.mA.fA.mA.fA.mG.fA.mG.fN' |
| F11-233NM | 1983 | PmN.fU.mC.fU.mU.fU.mG.fA.mG.fA.mU.fC.mU.mU.fU.mG.fG.mG | 2233 | fA.mA.fG.mA.fA.mU.fC.mU.fC.mA.fA.mA.fA.fN' |
| F11-234NM | 1984 | PmN.fA.mA.fU.mG.fA.mU.fG.mG.fA.mG.fC.mC.fU.mC.fC.mA.fC.mA | 2234 | fG.mA.fG.mG.fC.mU.fC.mC.fA.mU.fC.mA.fU.mU.fN' |
| F11-235NM | 1985 | PmN.fG.mA.fA.mG.fA.mA.fU.mG.fG.mC.fA.mG.fA.mA.fC.mA.fC.mU | 2235 | fU.mU.fC.mU.fG.mC.fC.mA.fU.mU.fC.mU.fU.mC.fN' |
| F11-236NM | 1986 | PmN.fC.mA.fA.mU.fG.mA.fU.mG.fG.mA.fG.mC.fC.mU.fC.mC.fA.mC | 2236 | fA.mG.fG.mC.fU.mC.fC.mA.fU.mC.fA.mU.fU.mG.fN' |
| F11-237NM | 1987 | PmN.fA.mU.fG.mG.fA.mG.fC.mC.fU.mC.fC.mA.fC.mA.fC.mA.fG.mG | 2237 | fU.mG.fU.mG.fG.mA.fG.mG.fC.mU.fC.mC.fA.mU.fN' |
| F11-238NM | 1988 | PmN.fC.mC.fC.mA.fA.mG.fA.mA.fA.mU.fC.mA.fG.mU.fG.mU.fC.mA | 2238 | fA.mC.fU.mG.fA.mU.fU.mU.fC.mU.fU.mG.fG.mG.fN' |
| F11-239NM | 1989 | PmN.fG.mA.fG.mC.fC.mU.fC.mC.fA.mC.fA.mC.fA.mG.fG.mU.fG.mU | 2239 | fC.mU.fG.mU.fG.mU.fG.mG.fA.mG.fG.mC.fU.mC.fN' |
| F11-240NM | 1990 | PmN.fC.mU.fC.mC.fC.mA.fA.mG.fA.mU.fC.mA.fG.mU.fG.mU | 2240 | fU.mG.fA.mU.fU.mU.fC.mU.fU.mG.fG.mG.fA.mG.fN' |
| F11-241NM | 1991 | PmN.fC.mC.fU.mC.fC.mA.fC.mA.fC.mA.fG.mG.fU.mG.fU.mC.fU.mC | 2241 | fC.mA.fC.mC.fU.mG.fU.mG.fU.mG.fG.mA.fG.mG.fN' |
| F11-242NM | 1992 | PmN.fC.mC.fA.mA.fU.mG.fA.mU.fG.mG.fA.mG.fC.mC.fU.mC.fC.mA | 2242 | fG.mG.fC.mU.fC.mC.fA.mU.fC.mA.fU.mU.fG.mG.fN' |
| F11-243NM | 1993 | PmN.fU.mU.fU.mC.fC.mA.fA.mU.fG.mA.fU.mG.fG.mA.fG.mC.fC.mU | 2243 | fU.mC.fA.mU.fU.mG.fG.mA.fA.mA.fN' |
| F11-244NM | 1994 | PmN.fU.mC.fC.mC.fA.mA.fG.mA.fA.mA.fU.mC.fA.mG.fU.mG.fU.mC | 2244 | fC.mU.fG.mA.fU.mU.fU.mC.fU.mU.fG.mG.fG.mA.fN' |
| F11-245NM | 1995 | PmN.fA.mG.fC.mC.fU.mC.fC.mA.fC.mA.fC.mA.fG.mG.fU.mG.fU.mC | 2245 | fC.mC.fU.mG.fU.mG.fU.mG.fG.mA.fG.mG.fC.mU.fN' |
| F11-246NM | 1996 | PmN.fU.mC.fU.mU.fC.mU.fC.mC.fC.mA.fA.mG.fA.mA.fA.mU.fC.mA | 2246 | fU.mU.fC.mU.fU.mG.fG.mG.fA.mG.ffA.mA.fG.mA.fN' |
| F11-247NM | 1997 | PmN.fG.mU.fU.mU.fC.mC.fA.mA.fU.mG.fA.mU.fG.mG.fA.mG.fC.mC | 2247 | fC.mC.fA.mU.fC.mA.fU.mU.fG.mG.A.mA.fA.mC.fN' |
| F11-248NM | 1998 | PmN.fU.mC.fC.mA.fA.mU.fG.mA.fU.mG.fG.mA.fG.mC.fC.mU.mC | 2248 | fG.mC.fU.mC.fC.mA.fU.mC.fA.mU.fU.mG.fG.mA.fN' |
| F11-249NM | 1999 | PmN.fU.mG.fG.mA.fG.mC.fC.mU.fC.mC.fA.mC.fA.mC.fA.mG.fG.mU | 2249 | fG.mU.fG.mU.fG.mG.fA.mG.fG.mC.fU.mC.fC.mA.fN' |
| F11-250NM | 2000 | PmN.fG.mC.fC.mU.fC.mC.fA.mC.fA.mC.fA.mG.fG.mU.fG.mU.fC.mU | 2250 | fA.mC.fC.fC.mU.fG.mU.fG.mU.fG.mG.fA.mG.fG.mC.fN' |

In above Table 1e:
A represents adenine;
U represents uracil;
C represents cytosine;
G represents guanine;
P represents a terminal phosphate group;
m represents a methyl modification at the 2' position of the sugar of the underlying nucleoside;
f represents a fluoro modification at the 2' position of the sugar of the underlying nucleoside
N represents any RNA nucleobase;
N' represents any RNA nucleobase and is preferably complementary to N.

Example 2

Oligonucleotides as set out in Tables 1a/1b above that target FXI mRNA in human hepatoma cells were screened as follows.

Native gel electrophoresis for random FXI oligomeric compounds: Oligomeric compounds including oligonucleotides as set out in Table 1a/1b above were dissolved in sterile Rnase-, Dnase free water to the final concentration 100 μM. 10 random oligomeric compounds were selected for validation based on following Table 2.

TABLE 2

| No. | Lot No. | ID |
|---|---|---|
| 1 | 32407 | F11-07 |
| 2 | 32443 | F11-43 |
| 3 | 32467 | F11-67 |
| 4 | 32482 | F11-82 |
| 5 | 32521 | F11-121 |
| 6 | 32530 | F11-130 |
| 7 | 32555 | F11-155 |
| 8 | 32596 | F11-196 |
| 9 | 32615 | F11-215 |
| 10 | 33642 | F11-242 |

20% TBE gel electrophoresis was carried out for the above oligomeric compounds of Table 2, 10 pm oligonucleotide/lane, staining: SybrGold. FIG. 1 illustrates the stability of the resulting duplexes. Based on this QC data we used all oligomeric compounds in the following screening.

Figure 2:
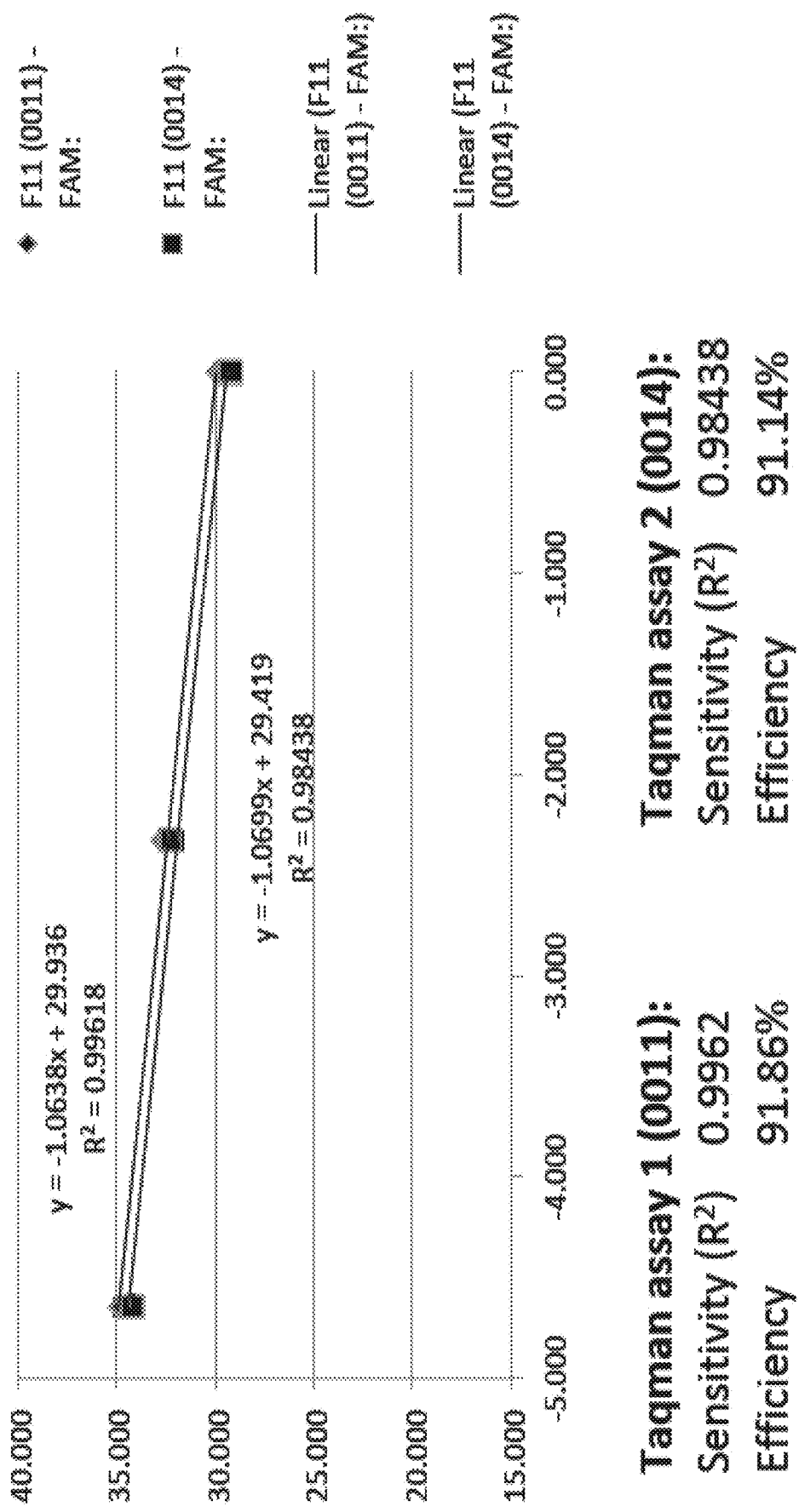
FIG. 2 illustrates the linear dose response of the two independent F11 qPCR assays as described in Example 2.
Figure 3:
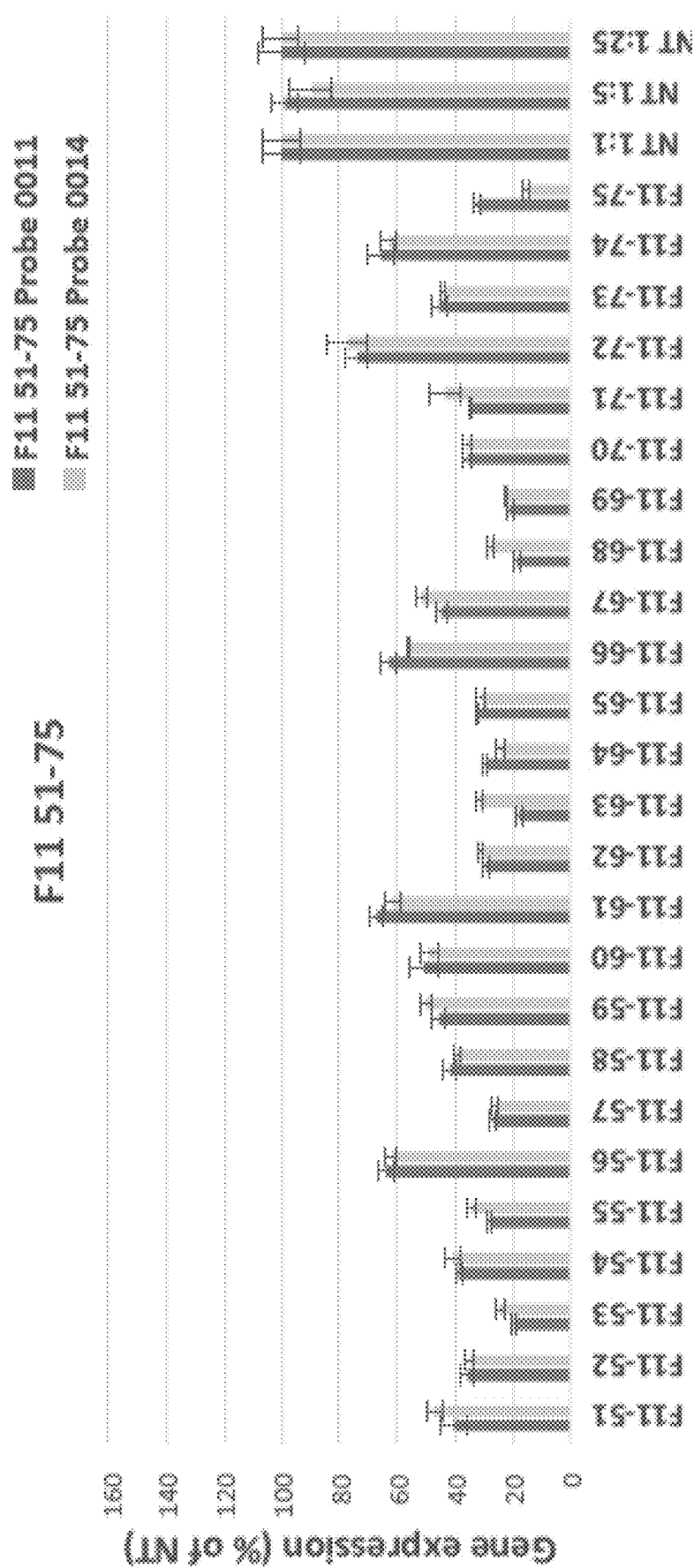
FIGS. 3 to 12 show the screening results for FXI gene expression as a percentage of gene expression in non-treated cells for oligomeric compounds including oligonucleotides of Table 1a/1b of Example 1.
Figure 4:
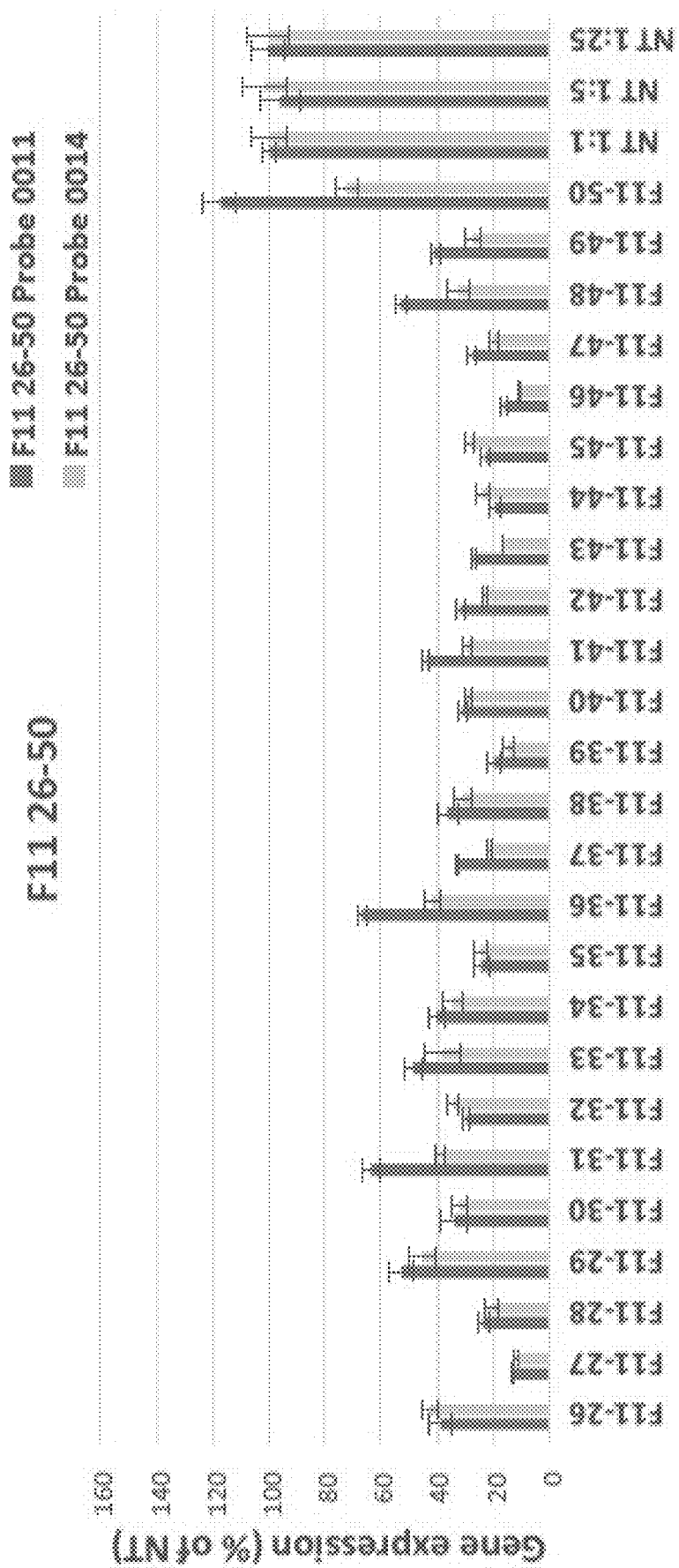
Figure 5:
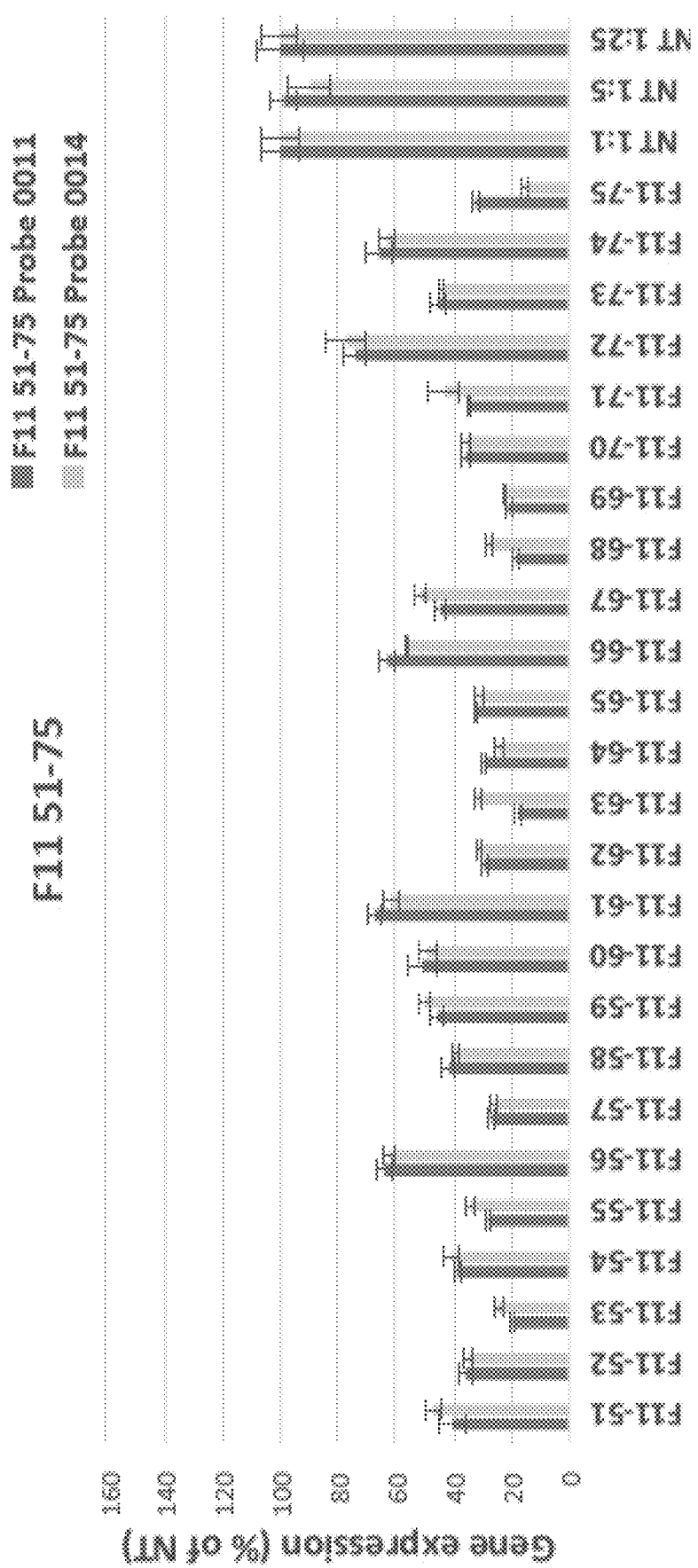
Figure 6:
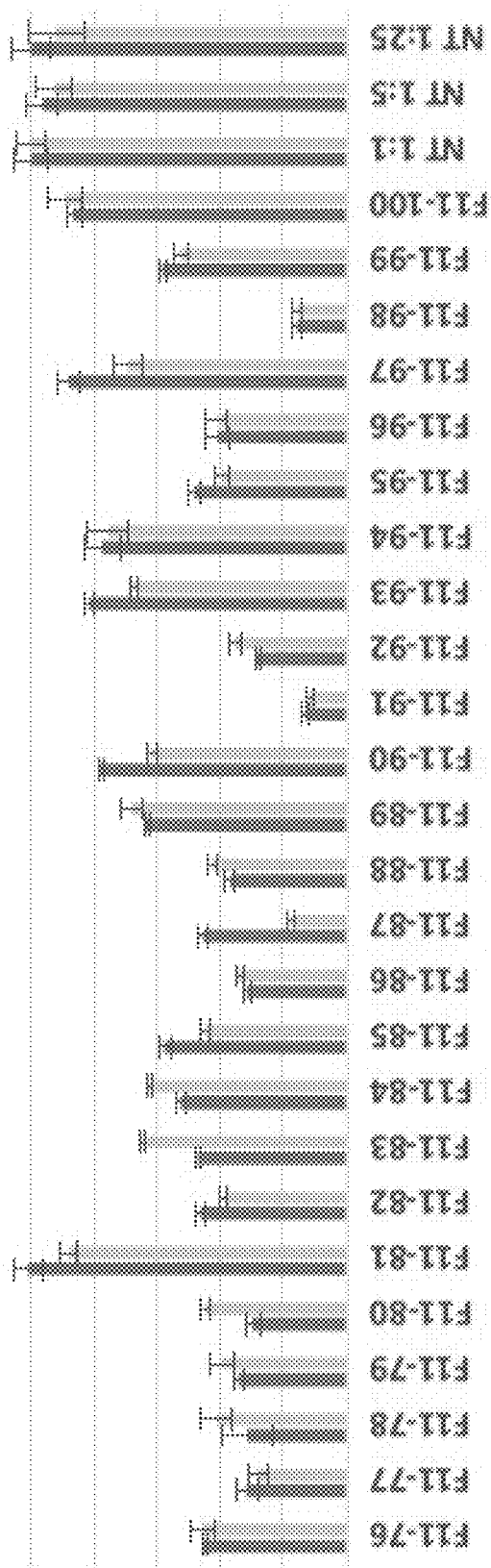
Figure 7:
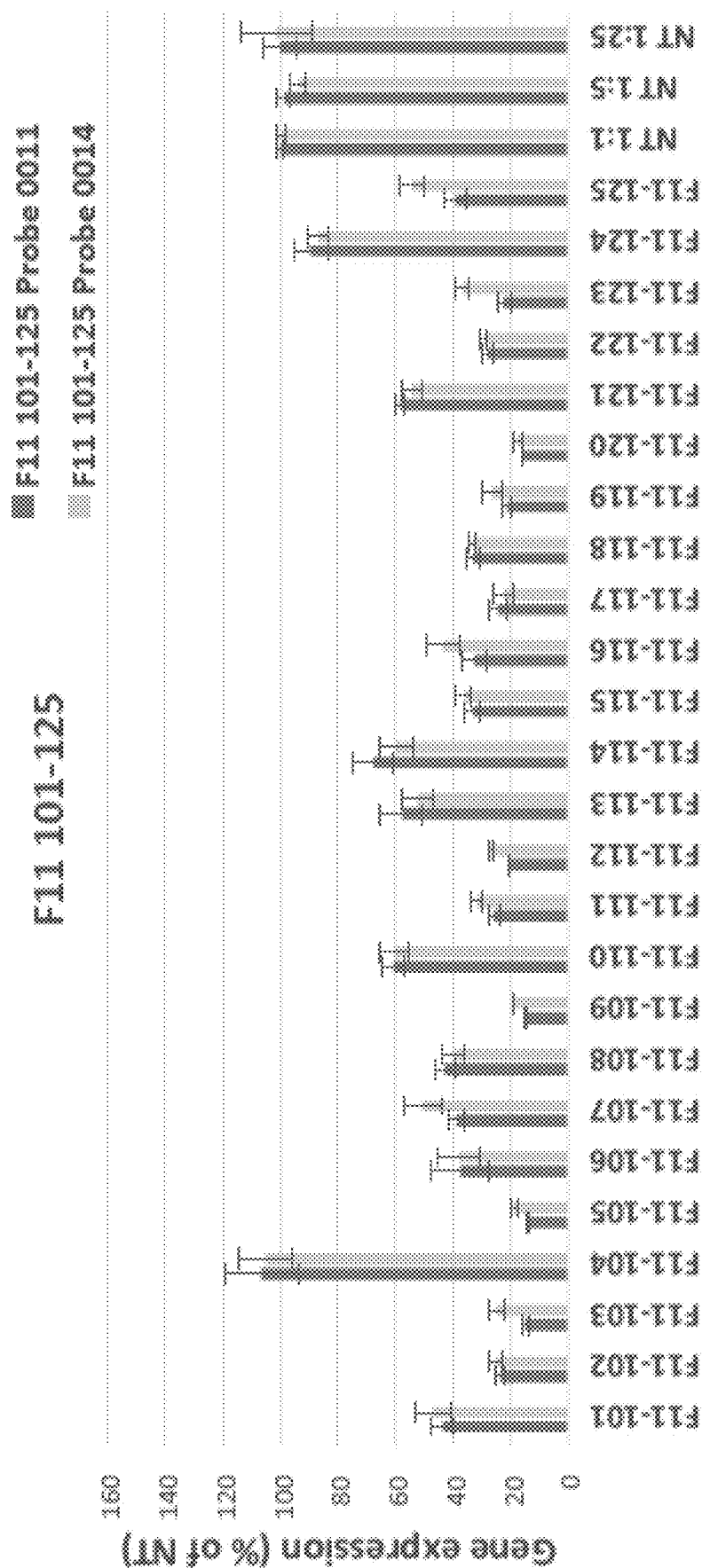
Figure 8:
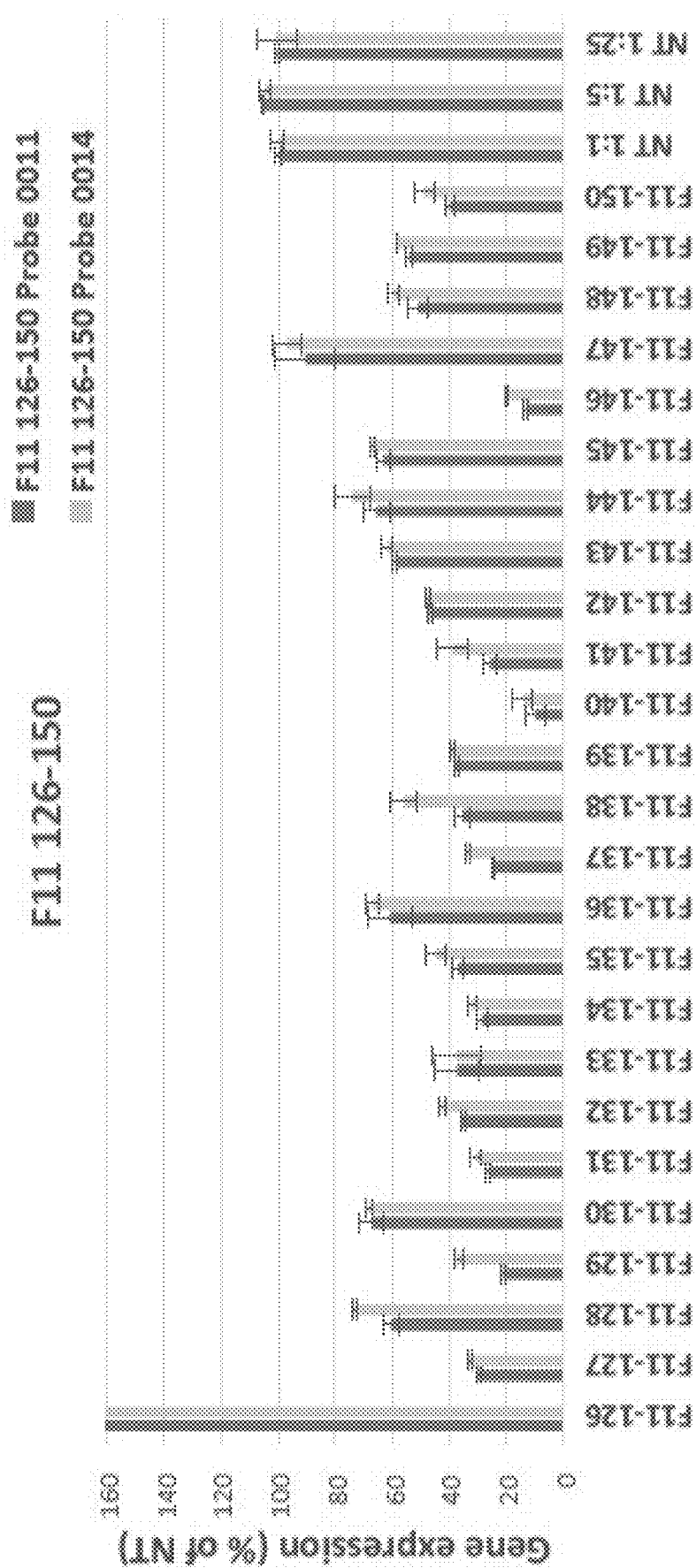
Figure 9:
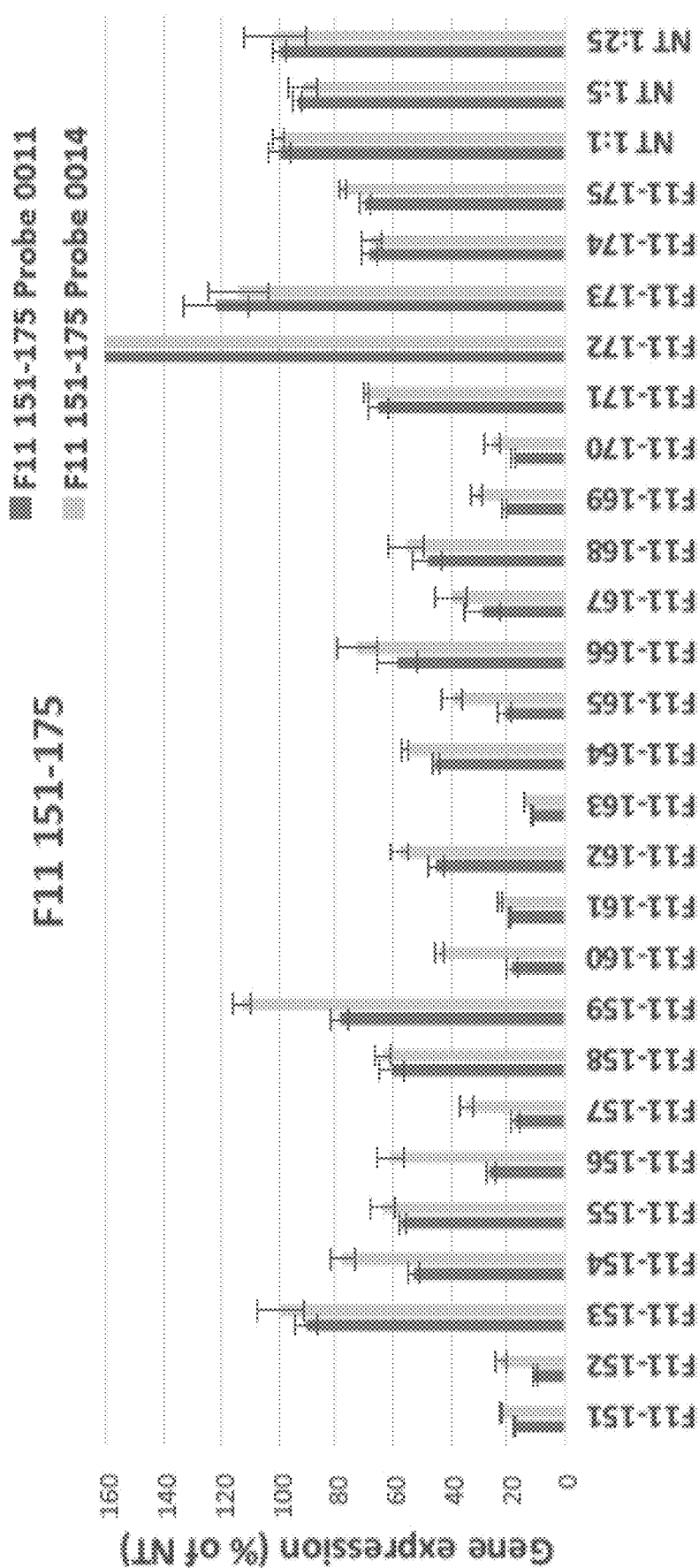
Figure 10:
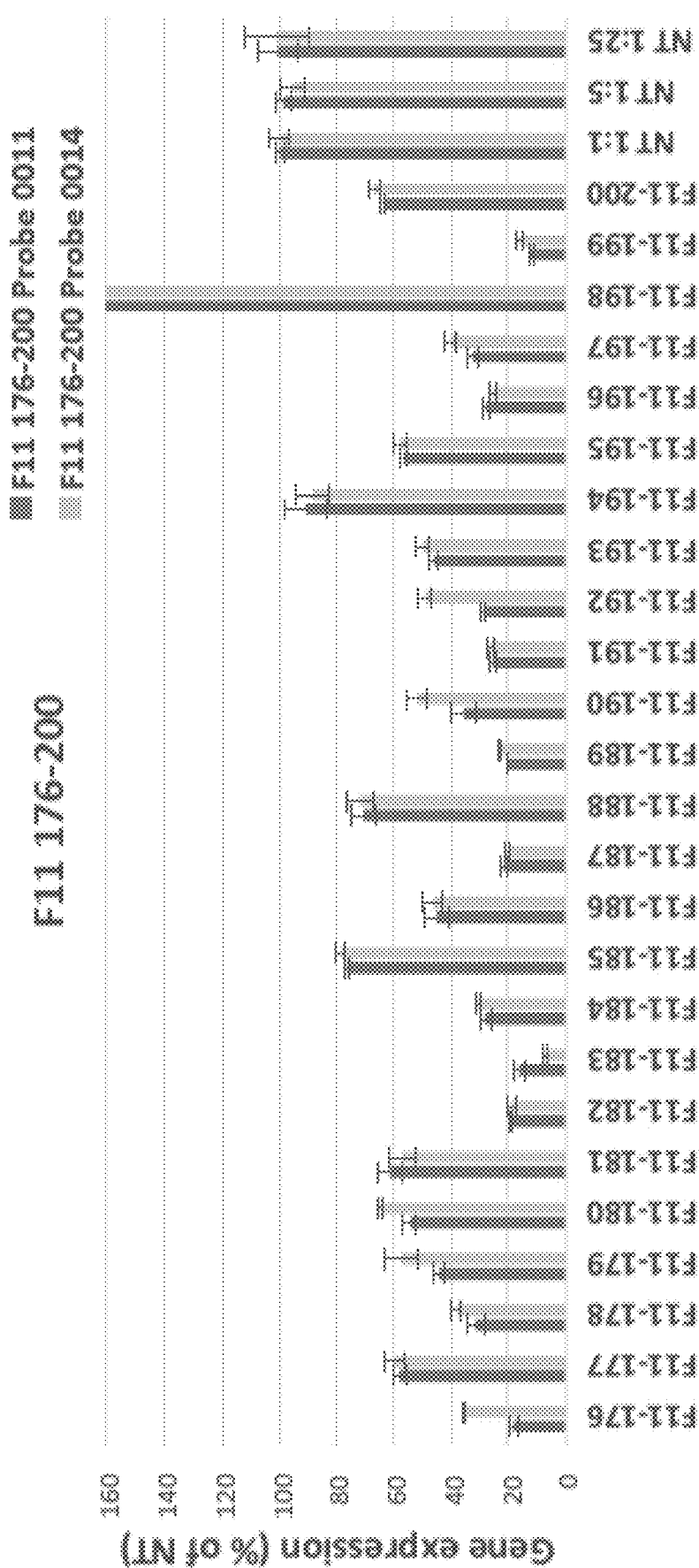
Figure 11:
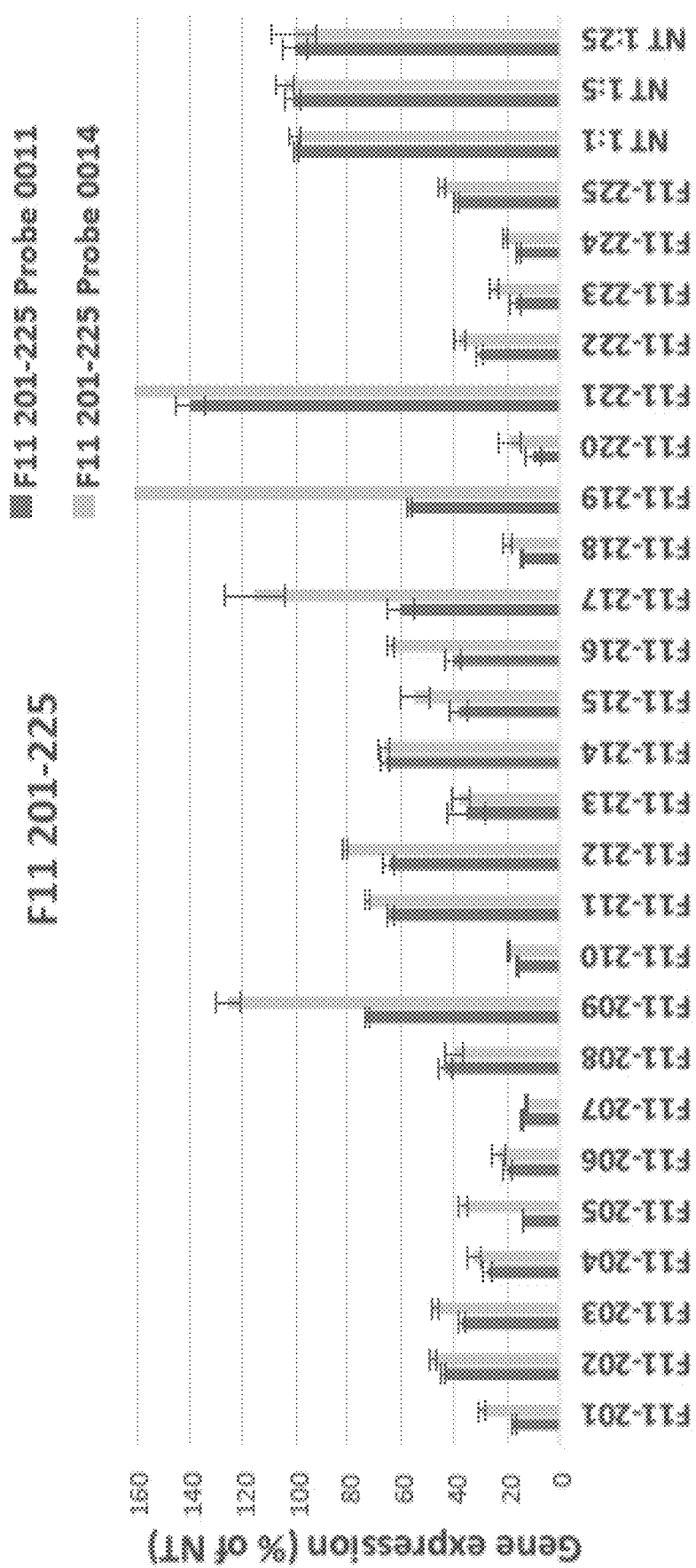
Figure 12:
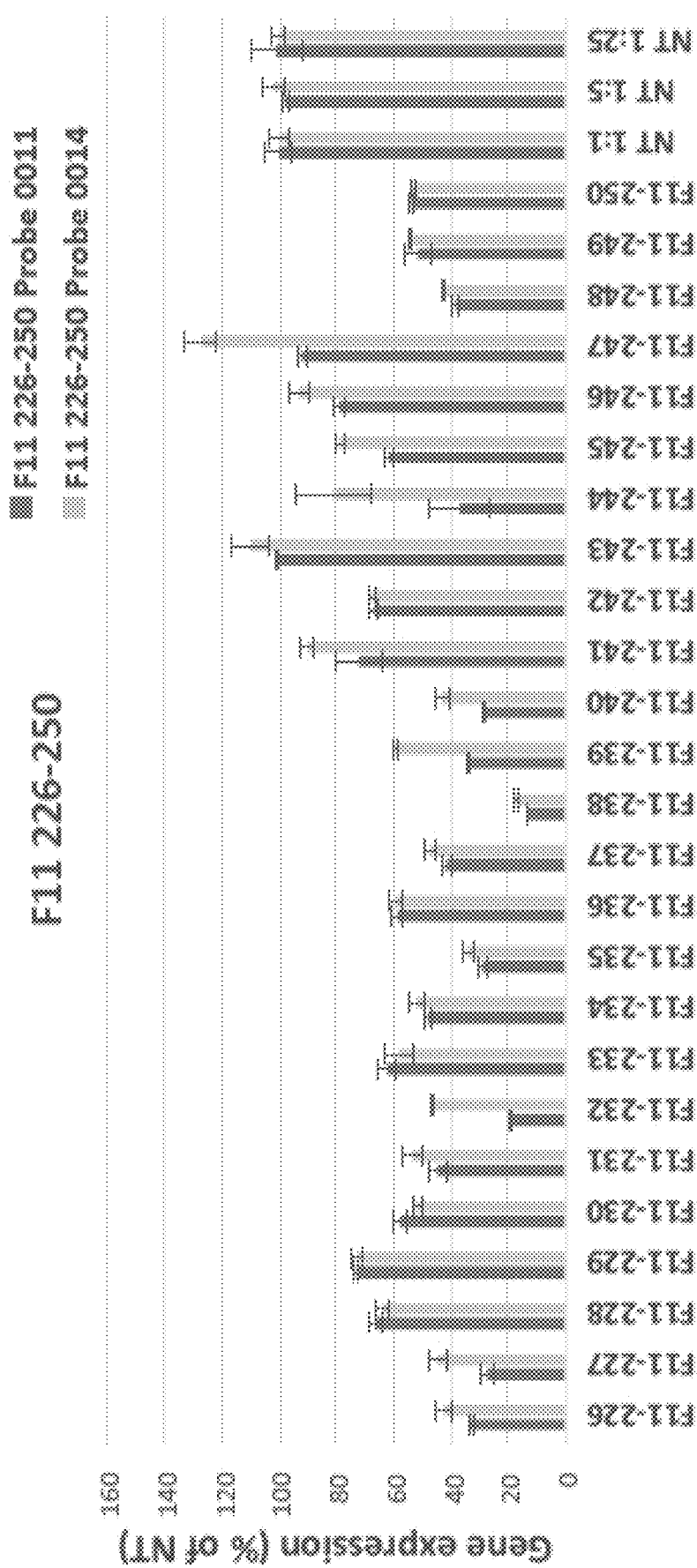

Two independent F11 qPCR assays and were validated for the screening. Both assays produced linear dose response as illustrated in FIG. 2 with high sensitivity and efficiency. Due to known qPCR artifacts caused by siRNAs overlapping with qPCR probe regions, two probes from different target gene regions were used.

Screening F11 Oligomeric Compounds in Hepatoma Cell Line: Protocol Details:
  Cell seeding: 10,000 HepG2 cells/well.
  Lipofectamine RNAiMax mediated transfection.
  Transfection: 20 nM compounds, antibiotic-free EMEM medium 10% FBS, 72 h incubation.
  Gene expression was measured by qPCR (Taqman chemistry), adjusted to the standard curve and normalized to the reference gene GAPDH.
  Data is expressed as the percentage of gene expression in non-treated cells (NT).
  Results of the screening are shown in FIGS. 3 to 12.

26 oligomeric compounds with 80% knockdown cut off were selected for the dose response curves. Basis for this selection is as follows in Table 3.

TABLE 3

| | Probe 0011 (% of NT) | Probe 0011 (StDev) | Probe 0014 (% of NT) | Probe 0014 (StDev) |
|---|---|---|---|---|
| F11-183 | 16.38125499 | 2.013845618 | 7.390709343 | 0.566515346 |
| F11-140 | 9.879406487 | 3.562127243 | 14.22784171 | 3.594956374 |
| F11-27 | 12.75921626 | 0.196272116 | 11.67948753 | 0.736184873 |
| F11-91 | 13.02726487 | 1.209635635 | 11.9438287 | 1.262506376 |
| F11-163 | 11.85412492 | 0.429451274 | 14.23620915 | 0.292814079 |
| F11-207 | 14.0604508 | 0.474611347 | 12.58144382 | 0.838626235 |
| F11-46 | 15.99580158 | 0.887618916 | 10.81760361 | 0.429607546 |
| F11-199 | 12.09311021 | 0.561879319 | 16.177289 | 0.804157804 |
| F11-220 | 10.19545315 | 2.801932011 | 18.89268438 | 4.374803266 |
| F11-238 | 13.40181876 | 0.052184671 | 17.3012001 | 1.131315389 |
| F11-98 | 15.77153606 | 1.342306305 | 15.82298746 | 1.641051662 |
| F11-105 | 14.09977643 | 0.481691161 | 18.58881771 | 1.10194639 |
| F11-146 | 13.12223851 | 1.009310781 | 19.79764347 | 0.70176306 |
| F11-152 | 10.7295455 | 0.718550243 | 22.44897671 | 1.853140055 |
| F11-109 | 14.71437898 | 0.483729553 | 18.58436211 | 0.097538284 |
| F11-120 | 15.82404014 | 0.296398359 | 17.48975387 | 2.035559291 |
| F11-218 | 14.31316962 | 0.304685608 | 19.64927627 | 1.469210086 |
| F11-13 | 15.75002936 | 0.544846368 | 18.21711753 | 0.233023069 |
| F11-39 | 19.6320507 | 2.268987147 | 14.61318275 | 1.740915389 |

TABLE 3-continued

| | Probe 0011 (% of NT) | Probe 0011 (StDev) | Probe 0014 (% of NT) | Probe 0014 (StDev) |
|---|---|---|---|---|
| F11-210 | 16.1566738 | 0.521574928 | 19.46520418 | 0.491427909 |
| F11-08 | 17.52268129 | 0.100107723 | 18.84244532 | 0.566323481 |
| F11-224 | 16.03733736 | 0.892648857 | 20.79529032 | 0.619058244 |
| F11-182 | 19.06641913 | 0.47270836 | 19.16890424 | 1.516153913 |
| F11-103 | 14.8052026 | 1.32389517 | 25.00603503 | 2.748462021 |
| F11-151 | 17.9105237 | 0.303879045 | 21.95923162 | 0.360854952 |
| F11-223 | 16.88767639 | 1.818246469 | 24.88274643 | 1.656451297 |

Example 3

Figure 13:
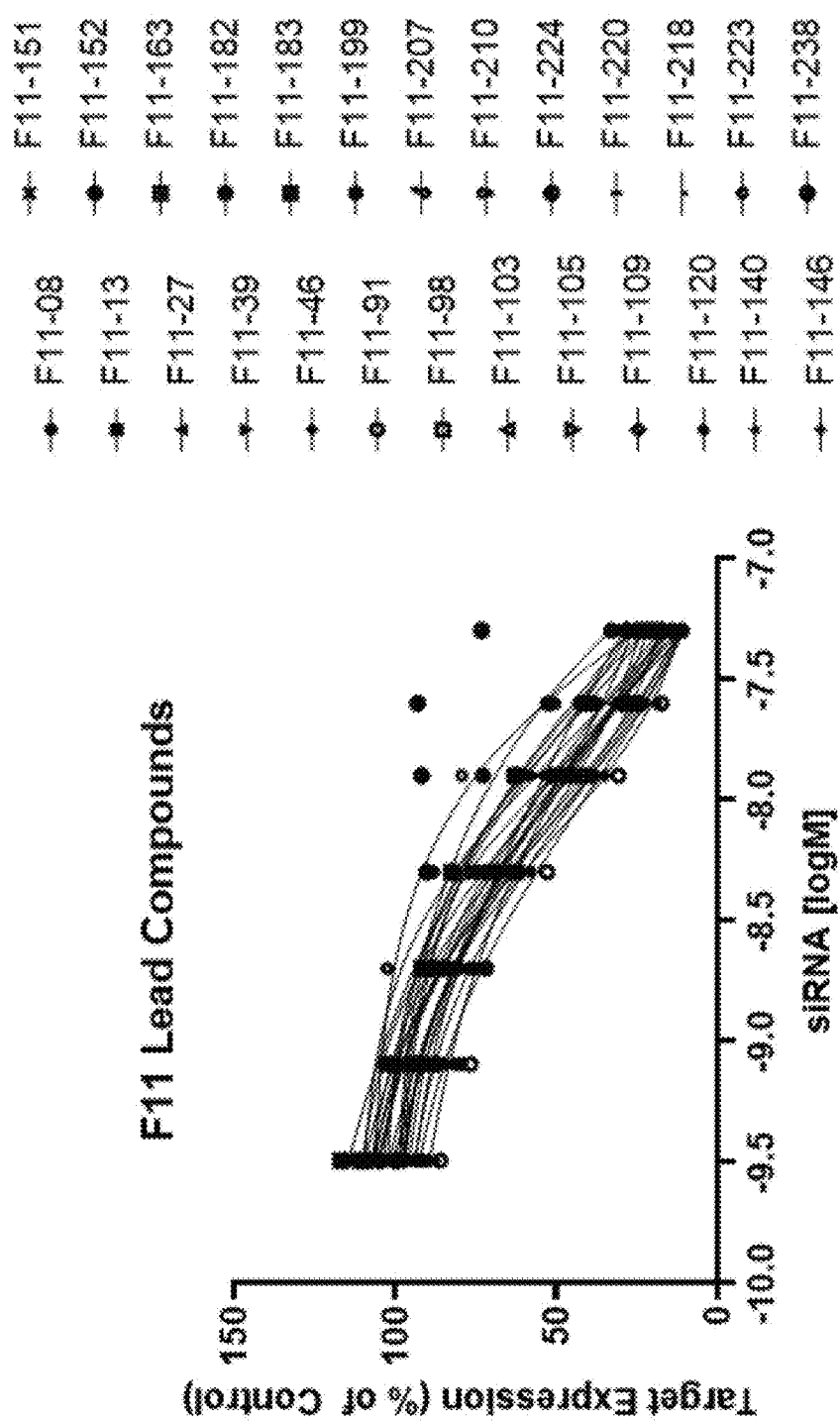
FIG. 13 provides dose response curves for the 26 FXI lead compounds as identified in Example 2.

Dose response curves for the 26 FXI lead compounds as identified in Example 2 are shown in FIG. 13.

Figure 14:
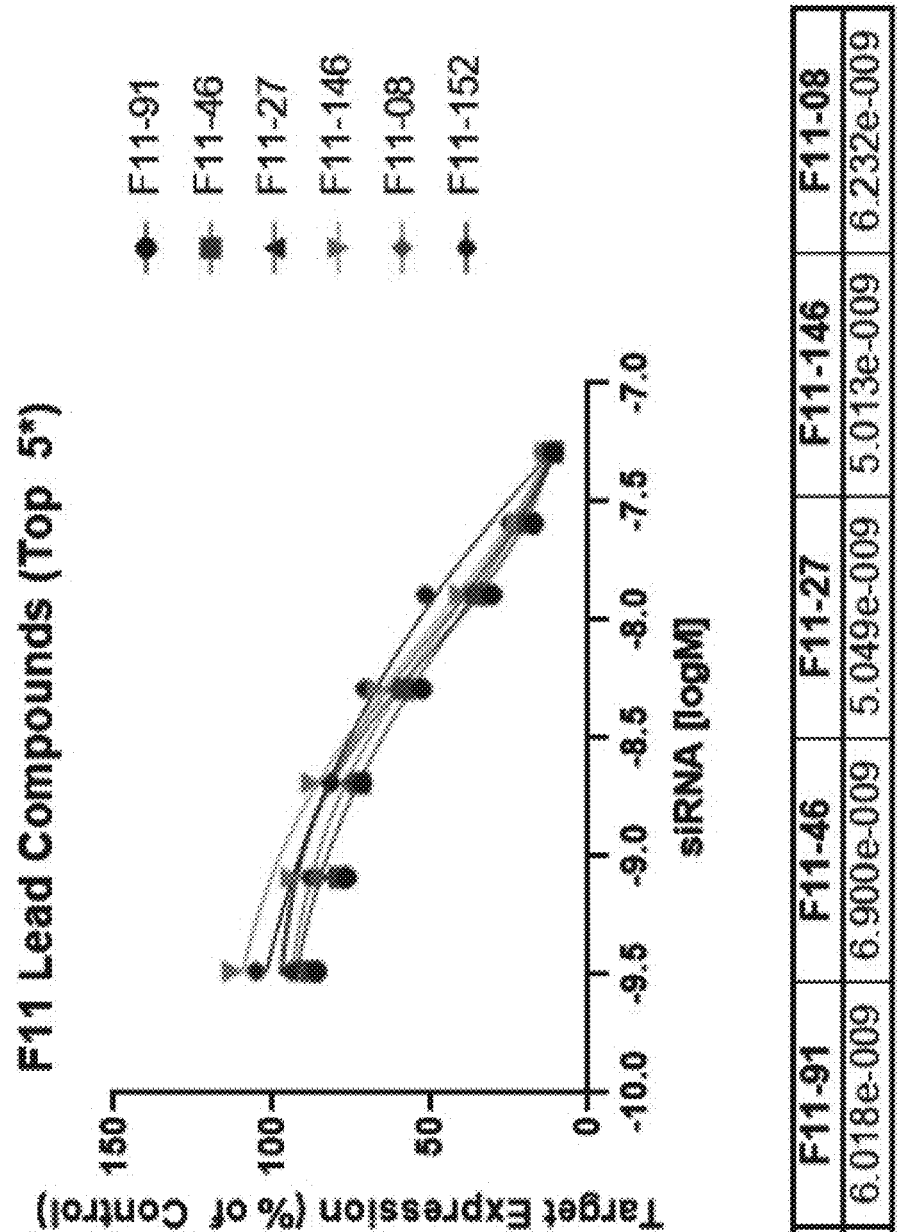
FIG. 14 provides dose response curves for the 5 FXI lead compounds as identified further to the results of FIG. 13.
Figure 18B:
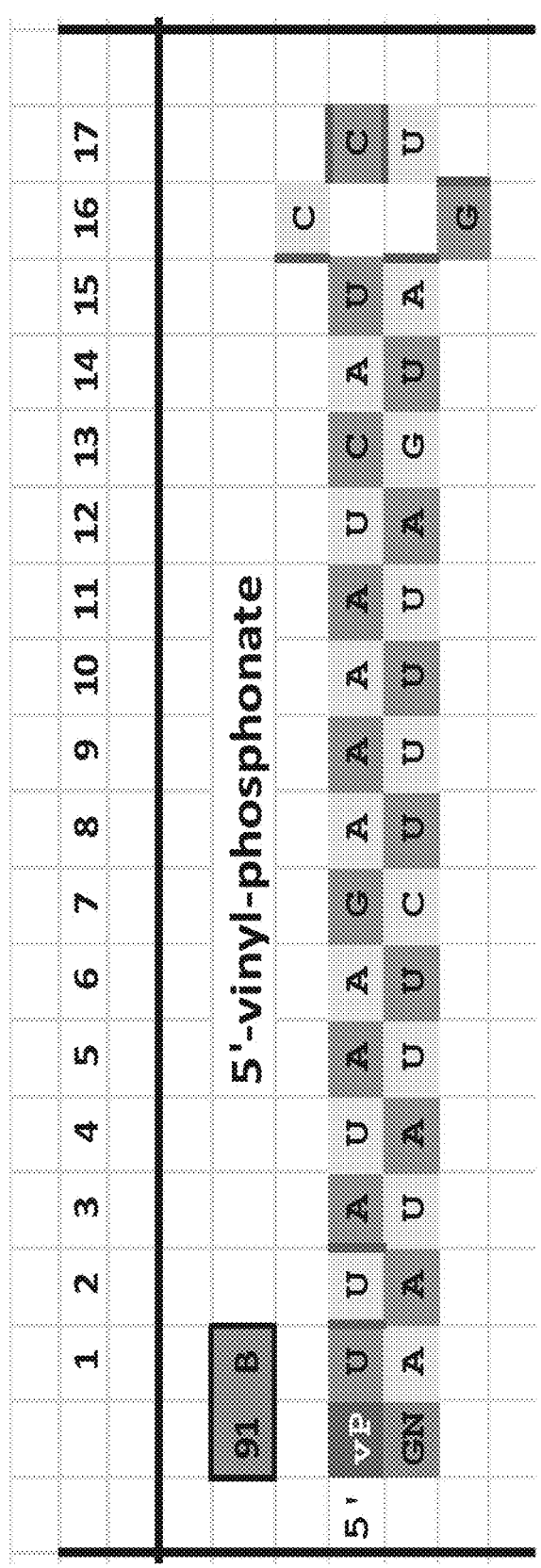
FIG. 18b illustrates a duplex containing 5' vinyl phosphonate. (91B, See also SEQ ID No. 2252).
Figure 18C:
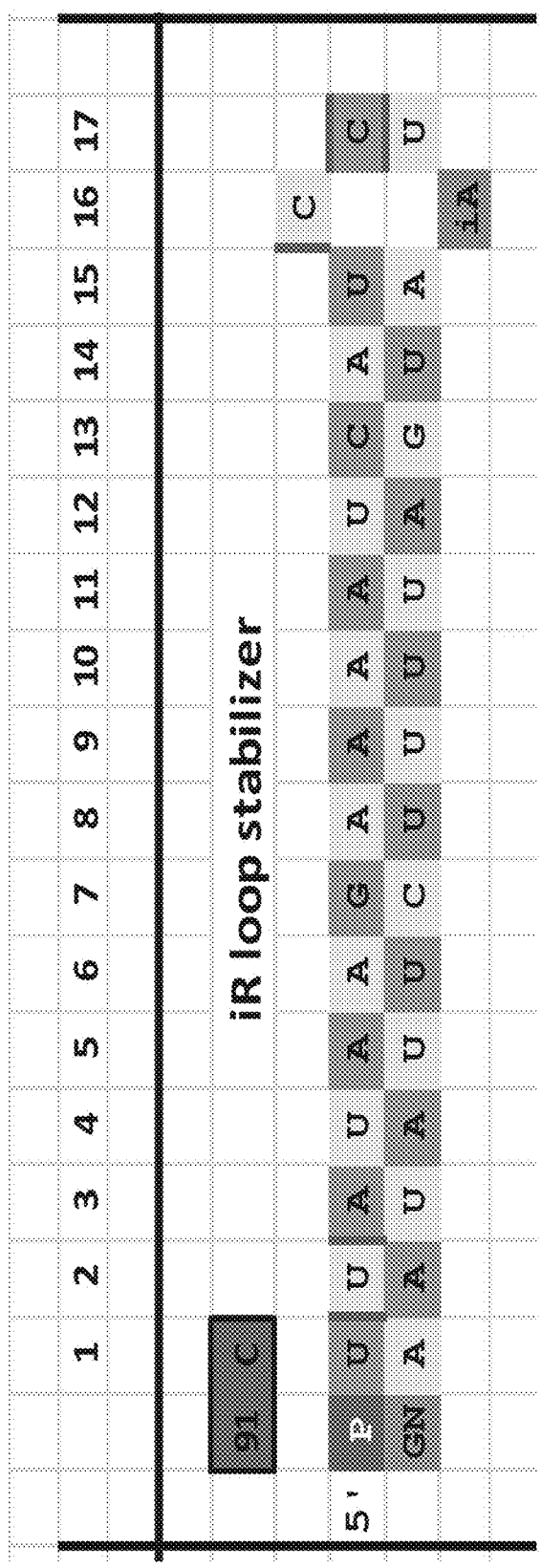
FIG. 18c illustrates a duplex containing an iR loop stabilizer. (91C, See also SEQ ID No. 2252).
Figure 18E:
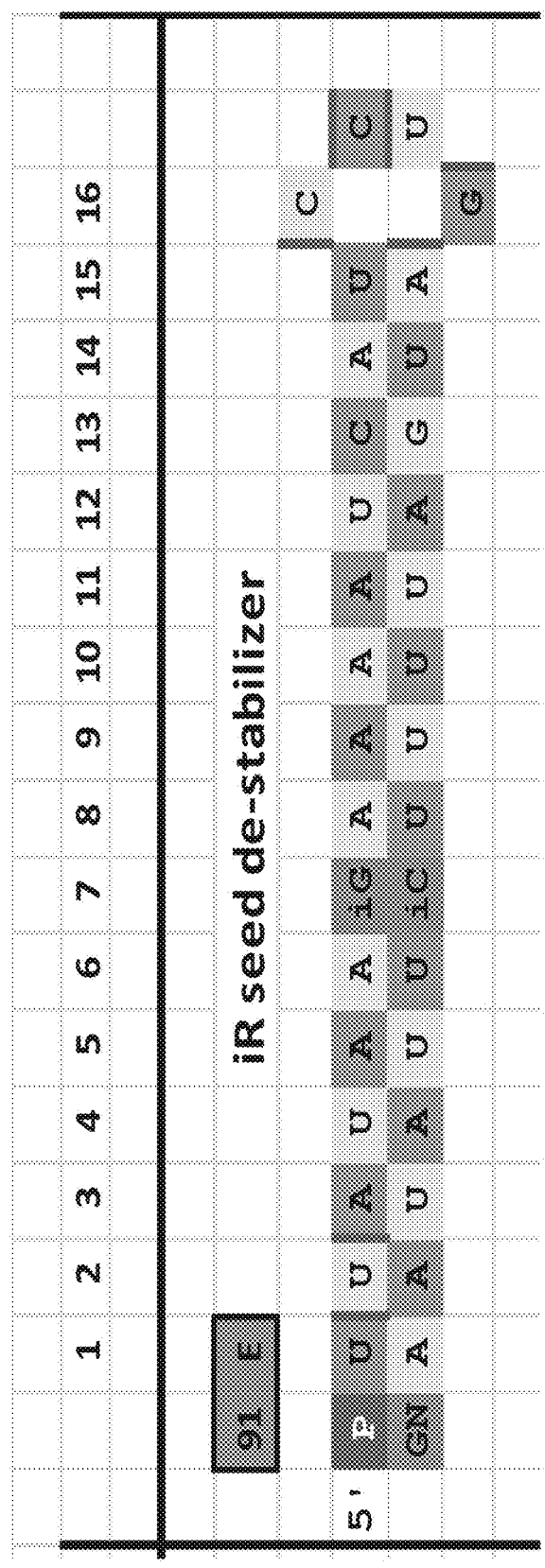
FIG. 18e illustrates a duplex containing an iR seed de-stabilizer. (91E, See also, SEQ ID No. 2252).
Figure 18F:
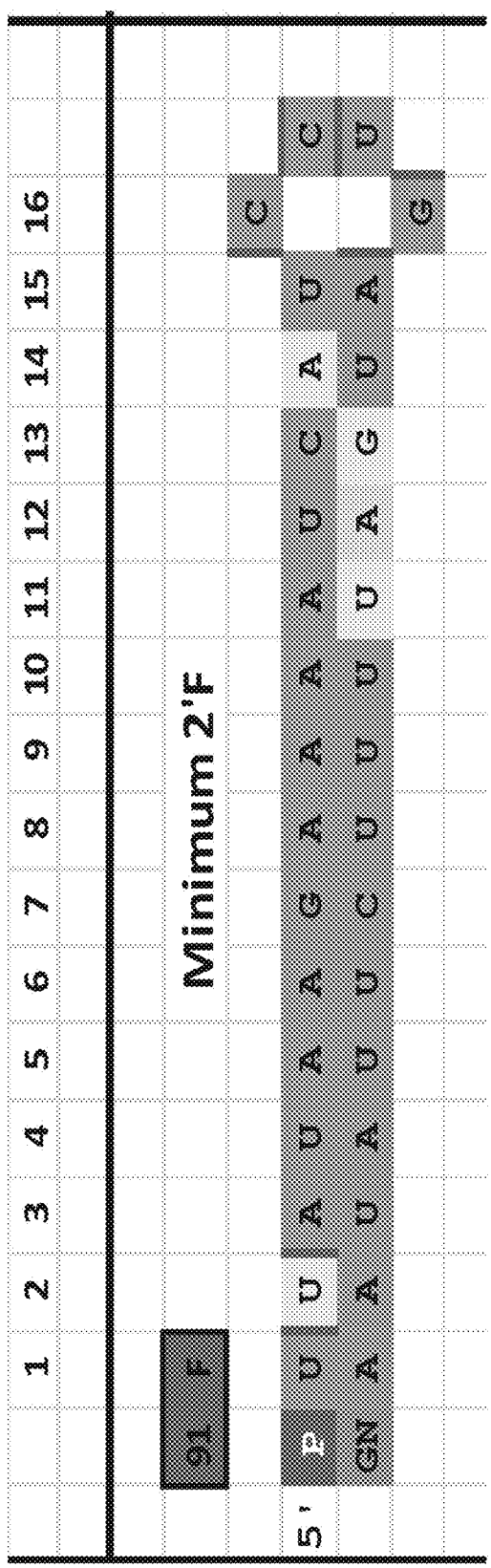
FIG. 18f illustrates a duplex containing a minimum 2'-F. (91F, See also SEQ ID No., 2252).
Figure 18G:
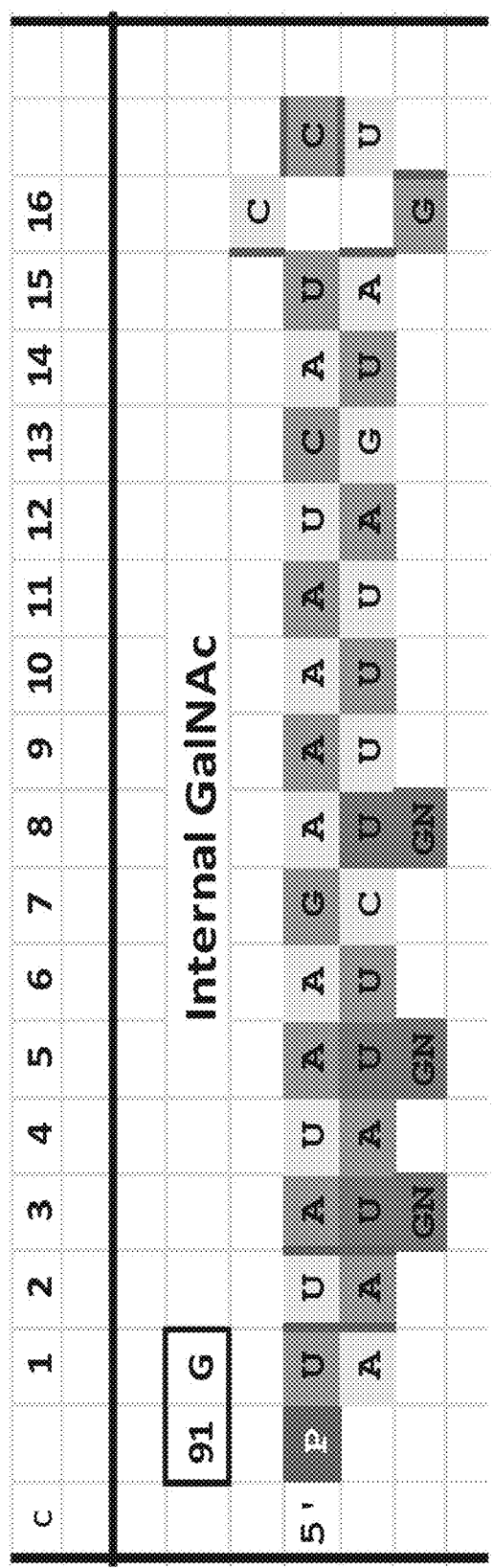
FIG. 18g illustrates a duplex containing internal GalNAc. (91G, See also SEQ ID No., 2252).
Figure 18G:
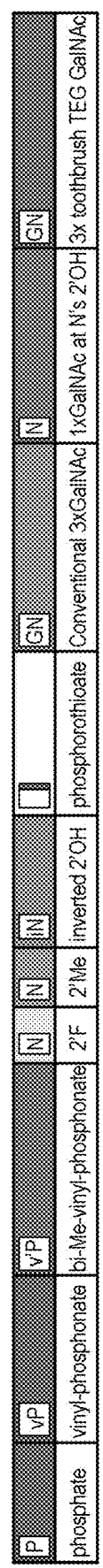
Figure 18I:
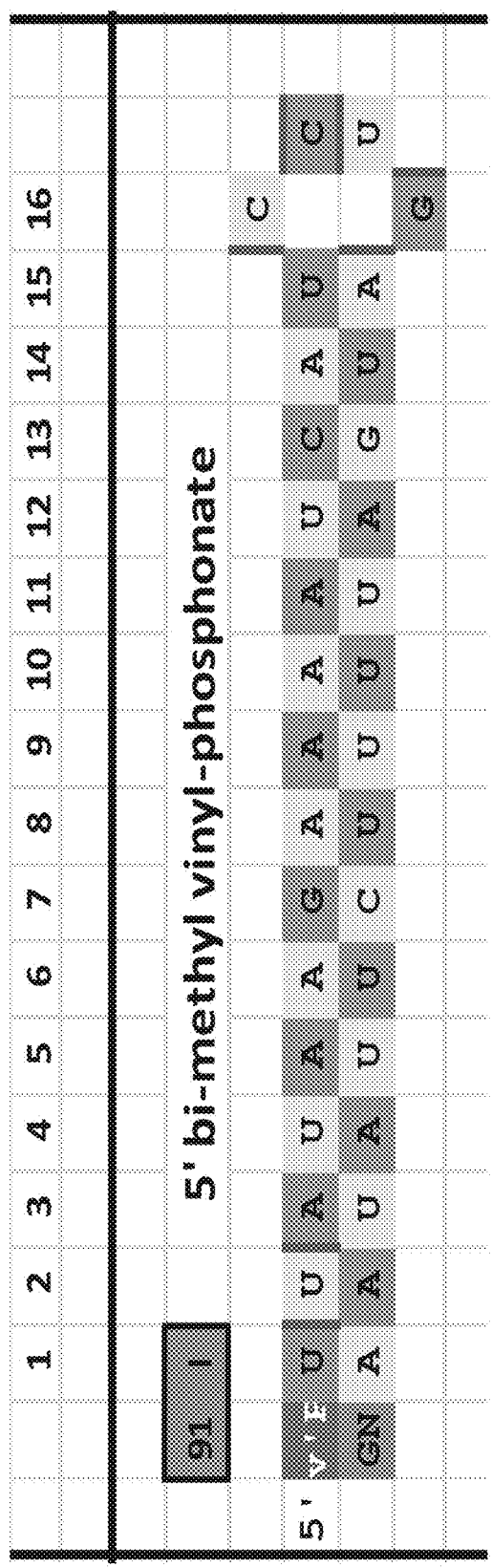
FIG. 18i illustrates a duplex containing 5' bi-methyl vinyl-phosphonate. (91 I, See also SEQ ID No. 2252).
Figure 18J:
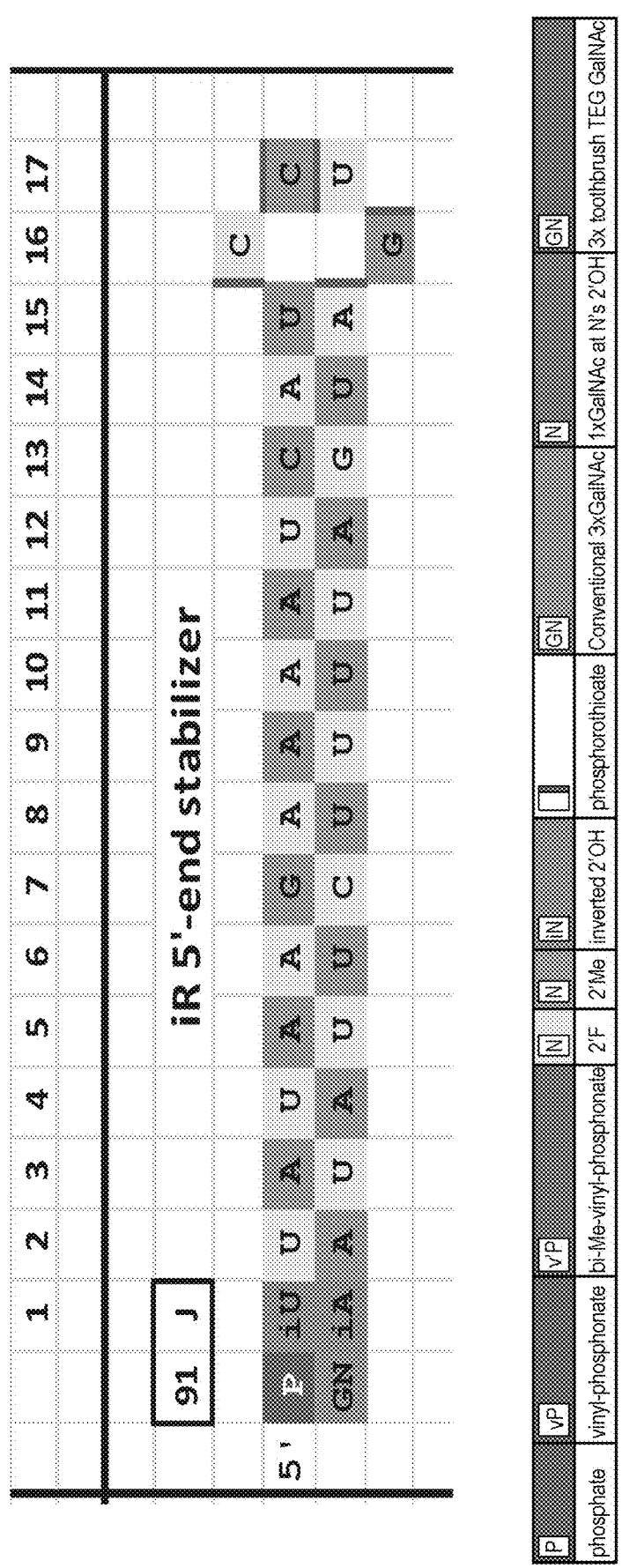
FIG. 18j illustrates a duplex containing iR 5'-end stabilizer. (91 J, See also SEQ ID No. 2252).
Figure 18I:
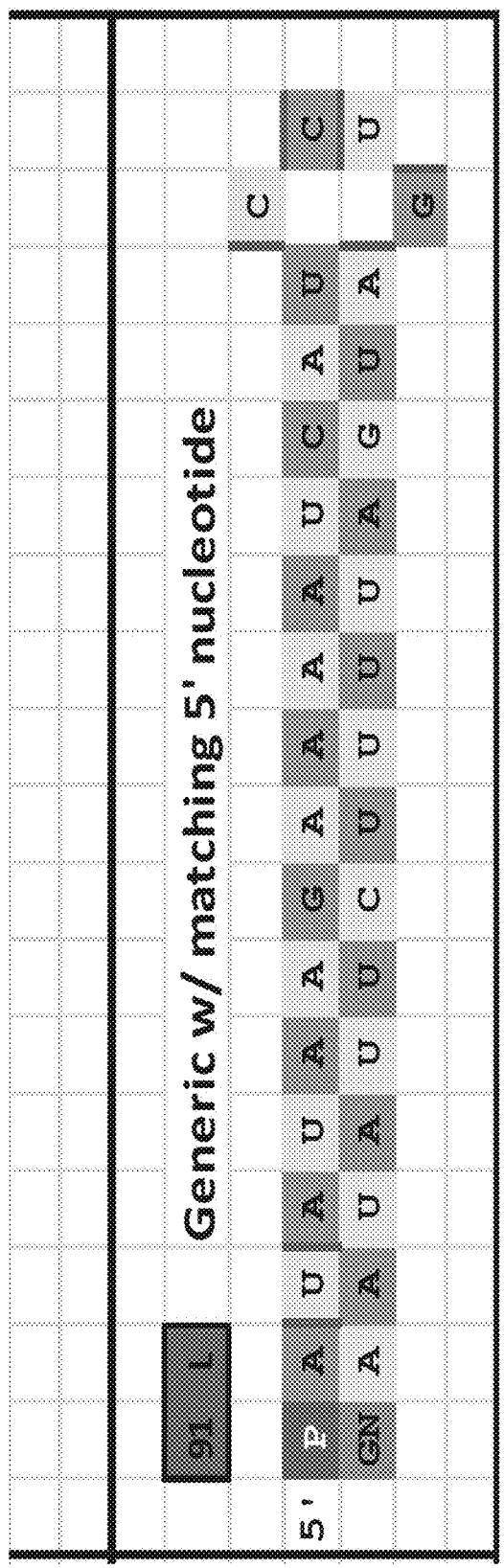
Figure 18I:
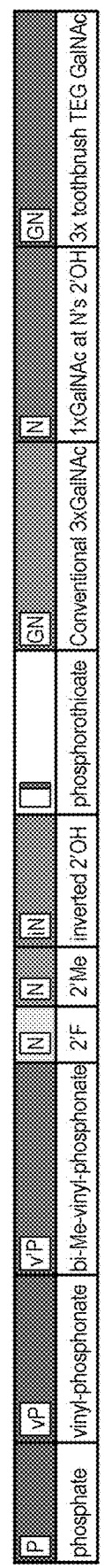
Figure 18P:
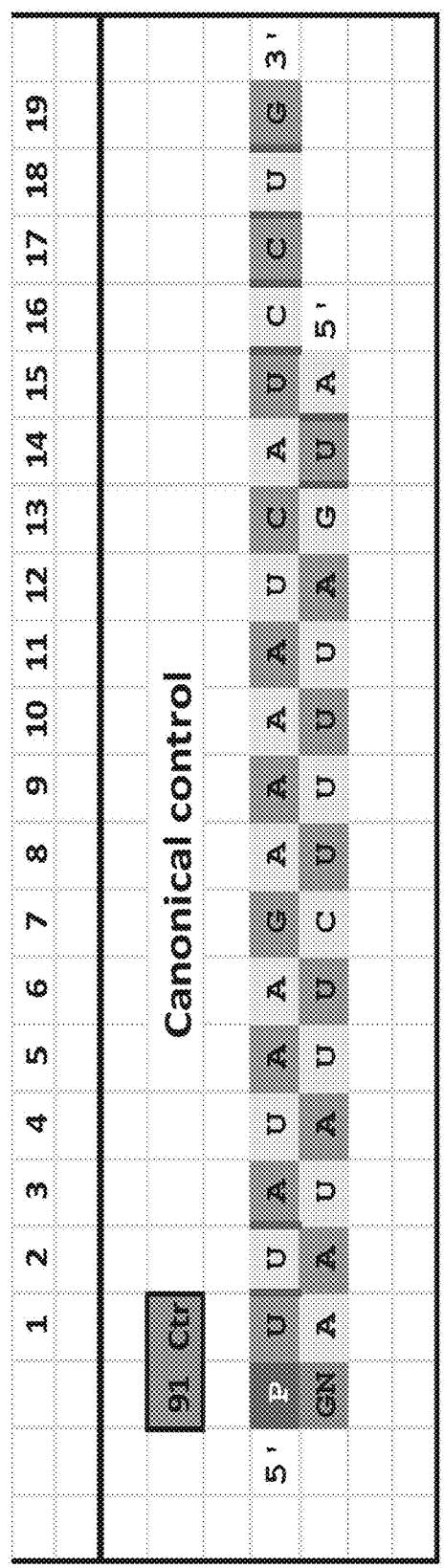
Figure 18P:
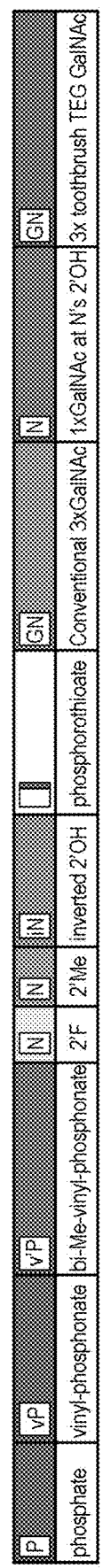

Dose response curves for the 5 FXI lead compounds are shown in FIG. 14.

Example 4

IC50 values are shown for the 26 FXI lead compounds as identified in Example 2 in following Table 4.

TABLE 4

| siRNA (nM) | 50 | 25 | 12.5 | 5 | 2 | 0.8 | 0.32 |
|---|---|---|---|---|---|---|---|
| F11-140 | 10.84824 | 27.26815 | 52.49094 | 74.79465 | 86.01931 | 92.5617 | 108.1231 |
| F11-91 | 11.21362 | 17.5123 | 30.79378 | 52.89924 | 71.85335 | 76.62539 | 86.24001 |
| F11-46 | 11.31357 | 19.1463 | 34.94334 | 58.3431 | 72.36898 | 79.03502 | 87.90456 |
| F11-27 | 12.00189 | 19.71206 | 36.34996 | 58.61257 | 73.49525 | 80.52213 | 95.02346 |
| F11-08 | 12.88477 | 23.17136 | 38.502 | 60.95352 | 75.64406 | 85.64319 | 94.30091 |
| F11-207 | 13.33847 | 28.59863 | 48.07128 | 70.58417 | 80.28337 | 83.17787 | 97.52694 |
| F11-146 | 13.38071 | 23.04423 | 40.71772 | 67.32095 | 87.86172 | 94.18917 | 112.7978 |
| F11-152 | 14.24965 | 24.9051 | 51.57466 | 70.85458 | 81.53343 | 88.18263 | 105.3212 |
| F11-13 | 16.1023 | 30.30924 | 48.19031 | 63.18166 | 75.90383 | 80.13827 | 91.06444 |
| F11-220 | 16.95432 | 25.76435 | 52.68453 | 80.69079 | 87.87234 | 98.52989 | 105.8545 |
| F11-218 | 17.20341 | 31.58884 | 61.17974 | 77.06415 | 101.7601 | 105.0303 | 109.3946 |
| F11-109 | 17.57553 | 29.90478 | 47.49863 | 67.90813 | 83.63117 | 99.25234 | 104.6814 |
| F11-105 | 17.62636 | 27.2131 | 48.11403 | 75.61487 | 91.99868 | 99.3779 | 113.5676 |
| F11-103 | 19.05623 | 31.3836 | 53.66986 | 70.21575 | 87.15926 | 94.18358 | 109.3758 |
| F11-98 | 19.08747 | 25.21664 | 40.70468 | 62.53904 | 90.33434 | 92.00181 | 109.9554 |
| F11-39 | 20.76369 | 36.33147 | 56.83281 | 71.87339 | 85.66001 | 88.7146 | 89.9771 |
| F11-183 | 22.96668 | 40.72956 | 62.72405 | 82.71394 | 91.62041 | 102.8007 | 117.0328 |
| F11-163 | 23.72934 | 27.92605 | 45.96363 | 70.65669 | 90.44246 | 95.26864 | 111.0215 |
| F11-223 | 25.55254 | 50.53311 | 79.41138 | 88.2778 | 102.639 | 100.4705 | 109.0358 |
| F11-151 | 25.79851 | 29.31085 | 43.72433 | 64.81009 | 83.78671 | 85.73753 | 101.2187 |
| F11-120 | 26.54193 | 37.32053 | 44.77477 | 68.73705 | 81.41065 | 91.22496 | 92.68608 |
| F11-199 | 28.11948 | 37.72515 | 63.274 | 74.59009 | 89.97225 | 96.10097 | 97.29022 |
| F11-224 | 28.19833 | 42.50665 | 62.41726 | 82.4676 | 85.58443 | 92.77884 | 100.0632 |
| F11-210 | 29.66767 | 37.73558 | 58.54817 | 67.94156 | 78.98299 | 88.30405 | 103.0938 |
| F11-182 | 32.95932 | 52.5532 | 72.82952 | 81.79542 | 88.47215 | 101.748 | 104.4618 |
| F11-238 | 73.20162 | 93.24065 | 91.91126 | 90.37185 | 88.5052 | 87.39394 | 99.47702 |

Example 5

Species cross-reactivity of the 26 FXI lead compounds as identified in Example 2 are shown in following Table 5.

TABLE 5

| Selected oligos | Macaca fascicularis | Mus musculus | Rattus norvegicus |
|---|---|---|---|
| F11-183 | MF | 0 | 0 |
| F11-140 | MF | 0 | 0 |
| F11-27 | 0 | 0 | 0 |
| F11-91 | MF | 0 | 0 |
| F11-163 | MF | 0 | 0 |
| F11-207 | MF | 0 | 0 |
| F11-46 | MF | 0 | 0 |
| F11-199 | MF | 0 | 0 |
| F11-220 | MF | 0 | 0 |
| F11-238 | MF | MUS | RN |
| F11-98 | MF | 0 | 0 |
| F11-105 | MF | 0 | 0 |
| F11-146 | MF | 0 | 0 |
| F11-152 | MF | MUS | RN |
| F11-109 | MF | 0 | 0 |
| F11-120 | MF | 0 | 0 |
| F11-218 | MF | 0 | 0 |
| F11-13 | MF | 0 | 0 |
| F11-39 | MF | 0 | RN |
| F11-210 | MF | 0 | 0 |
| F11-08 | MF | 0 | 0 |
| F11-224 | MF | 0 | 0 |
| F11-182 | MF | 0 | 0 |
| F11-103 | MF | 0 | 0 |
| F11-151 | MF | 0 | 0 |
| F11-223 | MF | 0 | 0 |

Example 6

Further to the data as provided in Examples 3 to 5, oligonucleotides F11-46/SEQ ID NO: 46, F11-91/SEQ ID NO: 91 and F11-152/SEQ ID NO: 152 have been identified as particularly preferred antisense oligonucleotide sequences to be used in oligomeric compounds as described herein. On this basis, these sequences have been incorporated into overall oligomeric compounds as described herein of the following sequences SEQ ID NOs 2251 to 2253 as set out in following Table 6. Furthermore, selected modifications have been applied to 10 SEQ ID NOS 2251 to 2253 as shown in SEQ ID NOs 2296 to 2325 and 2284 to 2286 in following Table 6. All sequences as provided below in Table 6 are set out in the 5' to 3' directionality.

TABLE 6

| Oligo Name | SEQ ID[1] or construct[2] No | Sequence |
|---|---|---|
| F11-46C (Oligomeric compound F11-46 complete sequence) | 2251 | UUGGUGUGAGCAUUGCUUGCAAUGCUCACACCAA (includes antisense SEQ ID NO 46, and sense SEQ ID NO 296) |

TABLE 6-continued

| Oligo Name | SEQ ID[1] or construct[2] No | Sequence |
|---|---|---|
| F11-91C (Oligomeric compound F11-91 complete sequence) | 2252 | UUAUAAGAAAAUCAUCCUGAUGAUUUUCUUAUAA (includes antisense SEQ ID NO 91, and sense SEQ ID NO 341) |
| F11-152 C (Oligomeric compound F11-152 complete sequence) | 2253 | UGGUUUCCAAUGAUGGAGCCAUCAUUGGAAACCA (includes antisense SEQ ID NO 152, and sense SEQ ID NO 402) |
| F11-46CPS (Oligomeric compound F11-46 complete sequence/ (ps) modified) | 2296 | mU(ps)fU(ps)mGfGmUfGmUfGmAfGmCfAmUfUmG(ps)fC(ps) mU(ps)fU(ps)mG(ps)fCmAfAmUfGmCfUmCfAmCfAmCfMafA (includes antisense SEQ ID NO 46, and sense SEQ ID NO 296) |
| F11-91CPS (Oligomeric compound F11-91 complete sequence/ (ps) modified) | 2297 | mU(ps)fU(ps)mAfUmAfAmGfAmAfAmAfUmCfAmU(ps)fC(ps)mC (ps)fU(ps)mG(ps)fAmUfGmAfUmUfUmUfCmUfUmAfUmAfA (includes antisense SEQ ID NO 91, and sense SEQ ID NO 341) |
| F11-152CPS (Oligomeric compound F11-152 complete / (ps) modified) | 2298 | mU(ps)fG(ps)mGfUmUfUmCfCmAfAmUfGmAfUmG(ps)fG(ps)mA (ps)fG(ps)mC(ps)fCmAfUmCfAmUfUmGfGmAfAmAfCmCfA (includes antisense SEQ ID NO 152, and sense SEQ ID NO 402) |
| F11-46VP (Oligomeric compound F11-46 complete sequence / ps and vinyl phosphonate modification) | 2299 | (VP)mU(ps)fU(ps)mGfGmUfGmUfGmAfGmCfAmUfUmG(ps)fC(ps) mU(ps)fU(ps)mG(ps)fCmAfAmUfGmCfUmCfAmCfAmCfMafA (includes antisense SEQ ID NO 46, and sense SEQ ID NO 296) |
| F11-91VP (Oligomeric compound F11-91 complete sequence / ps and vinyl phosphonate modification) | 2300 | (VP)mU(ps)fU(ps)mAfUmAfAmGfAmAfAmAfUmCfAmU(ps)fC(ps) mC(ps)fU(ps)mG(ps)fAmUfGmAfUmUfUmUfCmUfUmAfUmAfA (includes antisense SEQ ID NO 91, and sense SEQ ID NO 341) |
| F11-152VP (Oligomeric compound F11-152 complete sequence / ps and vinyl phosphonate modification) | 2301 | (VP)mU(ps)fG(ps)mGfUmUfUmCfCmAfAmUfGmAfUmG(ps)fG(ps) mA(ps)fG(ps)mC(ps)fCmAfUmCfAmUfUmGfGmAfAmAfCmCfA (includes antisense SEQ ID NO 152, and sense SEQ ID NO 402) |
| F11-46IL (Oligomeric compound F11-46 complete sequence / ps | 2302 | mU(ps)fU(ps)mGfGmUfGmUfGmAfGmCfAmUfUmG(ps)fC(ps)mU (ps)fUiGfCmAfAmUfGmCfUmCfAmCfAmCfMafA (includes antisense SEQ ID NO 46, and sense SEQ ID NO 296) |

TABLE 6-continued

| Oligo Name | SEQ ID[1] or construct[2] No | Sequence |
|---|---|---|
| and inverted nucleotide loop) | | |
| F11-91IL (Oligomeric compound F11-91 complete sequence / ps and inverted nucleotide loop) | 2303 | mU(ps)fU(ps)mAfUmAfAmGfAmAfAmAfUmCfAmU(ps)fC(ps)mC (ps)fUiGfAmUfGmAfUmUfUmUfCmUfUmAfUmAfA (includes antisense SEQ ID NO 91, and sense SEQ ID NO 341) |
| F11-152IL (Oligomeric compound F11-152 complete sequence / ps and inverted nucleotide loop) | 2304 | mU(ps)fG(ps)mGfUmUfUmCfCmAfAmUfGmAfUmG(ps)fG(ps)mA (ps)fGiCfCmAfUmCfAmUfUmGfGmAfAmAfCmCfA (includes antisense SEQ ID NO 152, and sense SEQ ID NO 402) |
| F11-46IE (Oligomeric compound F11-46 complete sequence / ps and end inverted nucleotide) | 2305 | mUiUmGfGmUfGmUfGmAfGmCfAmUfUmG(ps)fC(ps)mU(ps)fU (ps)mG(ps)fCmAfAmUfGmCfUmCfAmCfAmCfCiAfA (includes antisense SEQ ID NO 46, and sense SEQ ID NO 296) |
| F11-91IE (Oligomeric compound F11-91 complete sequence / ps and end inverted nucleotide) | 2306 | mUiUmAfUmAfAmGfAmAfAmAfUmCfAmU(ps)fC(ps)mC(ps)fU(ps) mG(ps)fAmUfGmAfUmUfUmUfCmUfUmAfUiAfA (includes antisense SEQ ID NO 91, and sense SEQ ID NO 341) |
| F11-152IE (Oligomeric compound F11-152 complete sequence / ps and end inverted nucleotide) | 2307 | mUiGmGfUmUfUmCfCmAfAmUfGmAfUmG(ps)fG(ps)mA(ps)fG (ps)mC(ps)fCmAfUmCfAmUfUmGfGmAfAmAfCiCfA (includes antisense SEQ ID NO 152, and sense SEQ ID NO 402) |
| F11-46II (Oligomeric compound F11-46 complete sequence / ps and internal inverted nucleotide) | 2308 | mU(ps)fU(ps)mGfGmUfGiUfGmAfGmCfAmUfUmG(ps)fC(ps)mU (ps)fU(ps)mG(ps)fmCfAmAfUmGfCfUmCiAmCfAmCfCmAfA (includes antisense SEQ ID NO 46, and sense SEQ ID NO 296) |
| F11-91II (Oligomeric compound F11-91 complete sequence / ps and internal inverted nucleotide) | 2309 | mU(ps)fU(ps)mAfUmAfAiGfAmAfAmAfUmCfAmU(ps)fC(ps)mC (ps)fU(ps)mG(ps)fAmUfGmAfUmUfUmUiCmUfUmAfUmAfA (includes antisense SEQ ID NO 91, and sense SEQ ID NO 341) |

TABLE 6-continued

| Oligo Name | SEQ ID[1] or construct[2] No | Sequence |
|---|---|---|
| F11-152II (Oligomeric compound F11-152 complete sequence / ps and internal inverted nucleotide) | 2310 | mU(ps)fG(ps)mGfUmUfUiCfCmAfAmUfGmAfUmG(ps)fG(ps)mA (ps)fG(ps)mC(ps)fCmAfUmCfAmUfUmGiGmAfAmAfCmCfA (includes antisense SEQ ID NO 152, and sense SEQ ID NO 402) |
| F11-46MF (Oligomeric compound F11-46 complete sequence / ps and minimum 2F) | 2311 | mU(ps)fU(ps)mGmGmUmGmUmGmAmGmCmAmUfUmG(ps)mC (ps)mU(ps)mU(ps)mG(ps)mCmAfAfUfGmCmUmCmAmCmAm CmCmAmA (includes antisense SEQ ID NO 46, and sense SEQ ID NO 296) |
| F11-91MF (Oligomeric compound F11-91 complete sequence / ps and minimum 2F) | 2312 | mU(ps)fU(ps)mAmUmAmAmGmAmAmAmAmUmCfAmU(ps)mC (ps)mC(ps)mU(ps)mG(ps)mAmUfGfAfUmUmUmCmUmUmA mUmAmA (includes antisense SEQ ID NO 91, and sense SEQ ID NO 341) |
| F11-152MF (Oligomeric compound F11-152 complete sequence / ps and minimum 2F) | 2313 | mU(ps)fG(ps)mGmUmUmUmCmCmAmAmUmGmAfUmG(ps)mG (ps)mA(ps)mG(ps)mC(ps)mCmAfUfCfAmUmUmGmGmAmAm AmCmCmA (includes antisense SEQ ID NO 152, and sense SEQ ID NO 402) |
| F11-46ILG (Oligomeric compound F11-46 complete sequence / ps and internal ligand arrangement) | 2314 | mU(ps)fU(ps)mGfGmUfGmUfGmAfGmCfAmUfUmG(ps)fC(ps)mU (ps)fU(ps)mG(ps)fCmAfAmUfGmCfUCfACfAmCC(ps)mA(ps)fA (includes antisense SEQ ID NO 46, and sense SEQ ID NO 296) |
| F11-91ILG (Oligomeric compound F11-91 complete sequence / ps and internal ligand arrangement) | 2315 | mU(ps)fU(ps)mAfUmAfAmGfAmAfAmAfUmCfAmU(ps)fC(ps)mC (ps)fU(ps)mG(ps)fAmUfGmAfUmUfUUfCmUUmAU(ps)mA(ps)fA (includes antisense SEQ ID NO 91, and sense SEQ ID NO 341) |
| F11-152ILG (Oligomeric compound F11-152 complete sequence / ps and internal ligand arrangement) | 2316 | mU(ps)fG(ps)mGfUmUfUmCfCmAfAmUfGmAfUmG(ps)fG(ps)mA (ps)fG(ps)mC(ps)fCmAUmCfAUUmGfGmAfAmAC(ps)mC(ps)fA (includes antisense SEQ ID NO 152, and sense SEQ ID NO 402) |

TABLE 6-continued

| Oligo Name | SEQ ID[1] or construct[2] No | Sequence |
|---|---|---|
| F11-46ILGIE (Oligomeric compound F11-46 complete sequence / ps, internal ligand arrangement and inverted nucleotide end stabilization) | 2317 | mU(ps)fU(ps)mGfGmUfGmUfGmAfGmCfAmUfUmG(ps)fC(ps)mU(ps)fU(ps)mG(ps)fCmAfAmUfGmCfUCfACfAmCCmAiN"mN'" (includes antisense SEQ ID NO 46, and sense SEQ ID NO 296) |
| F11-91ILGIE (Oligomeric compound F11-91 complete sequence / ps, internal ligand arrangement and inverted nucleotide end stabilization) | 2318 | mU(ps)fU(ps)mAfUmAfAmGfAmAfAmAfUmCfAmU(ps)fC(ps)mC(ps)fU(ps)mG(ps)fAmUfGmAfUmUfUUfCmUUmAUmAiN"mN'" (includes antisense SEQ ID NO 91, and sense SEQ ID NO 341) |
| F11-152ILGIE (Oligomeric compound F11-152 complete sequence / ps, internal ligand arrangement and inverted nucleotide end stabilization) | 2319 | mU(ps)fG(ps)mGfUmUfUmCfCmAfAmUfGmAfUmG(ps)fG(ps)mA(ps)fG(ps)mC(ps)fCmAUmCfAUUmGfGmAfAmACmCiN"mN'" (includes antisense SEQ ID NO 152, and sense SEQ ID NO 402) |
| F11-46MVP (Oligomeric compound F11-46 complete sequence / ps and methyl vinyl phosphonate modification) | 2320 | (mVP)mU(ps)fU(ps)mGfGmUfGmUfGmAfGmCfAmUfUmG(ps)fC(ps)mU(ps)fU(ps)mG(ps)fCmAfAmUfGmCfUmCfAmCfCmAfA (includes antisense SEQ ID NO 46, and sense SEQ ID NO 296) |
| F11-91MVP (Oligomeric compound F11-91 complete sequence / ps and methyl vinyl phosphonate modification) | 2321 | (mVP)mU(ps)fU(ps)mAfU mAfAmGfAmAfAmAfU mCfAmU(ps)fC(ps)mC(ps)fU(ps)mG(ps)fAmUfGmAfUmUfUmUfCmUfUmAfUmAfA (includes antisense SEQ ID NO 91, and sense SEQ ID NO 341) |
| F11-152MVP (Oligomeric compound F11-152 complete sequence / ps and methyl vinyl phosphonate modification) | 2322 | (mVP)mU(ps)fG(ps)mGfUmUfUmCfCmAfAmUfGmAfUmG(ps)fG(ps)mA(ps)fG(ps)mC(ps)fCmAfUmCfAmUfUmGfGmAfAmAfCmCfA (includes antisense SEQ ID NO 152, and sense SEQ ID NO 402) |

TABLE 6-continued

| Oligo Name | SEQ ID[1] or construct[2] No | Sequence |
|---|---|---|
| F11-46IT (Oligomeric compound F11-46 complete sequence / PS and inverted nucleotide terminal stabilization) | 2323 | iUfUmGfGmUfGmUfGmAfGmCfAmUfUmG(ps)fC(ps)mU(ps)fU(ps) mG(ps)fCmAfAmUfGmCfUmCfAmCfAmCfCmAiA (includes antisense SEQ ID NO 46, and sense SEQ ID NO 296) |
| F11-91IT (Oligomeric compound F11-91 complete sequence / PS and inverted nucleotide terminal stabilization) | 2324 | iUfUmAfUmAfAmGfAmAfAmAfUmCfAmU(ps)fC(ps)mC(ps)fU(ps) mG(ps)fAmUfGmAfUmUfUmUfCmUfUmAfUmAiA (includes antisense SEQ ID NO 91, and sense SEQ ID NO 341) |
| F11-152IT (Oligomeric compound F11-152 complete sequence / PS and inverted nucleotide terminal stabilization) | 2325 | iUfGmGfUmUfUmCfCmAfAmUfGmAfUmG(ps)fG(ps)mA(ps)fG (ps)mC(ps)fCmAfUmCfAmUfUmGfGmAfAmAfCmCiA (includes antisense SEQ ID NO 152, and sense SEQ ID NO 402) |
| F11-46CM (Oligomeric compound F11-46 complete sequence) | 2284 | NUUGGUGUGAGCAUUGCUUGCAAUGCUCACACCAN' (includes antisense SEQ ID NO 46, and sense SEQ ID NO 296) |
| F11-91CM (Oligomeric compound F11-91 complete sequence) | 2285 | NUAUAAGAAAAUCAUCCUGAUGAUUUUCUUAUAN' (includes antisense SEQ ID NO 91, and sense SEQ ID NO 341) |
| F11-152CM (Oligomeric compound F11-152 complete sequence) | 2286 | NGGUUUCCAAUGAUGGAGCCAUCAUUGGAAACCN' (includes antisense SEQ ID NO 152, and sense SEQ ID NO 402) |

[1] In case of nucleobase sequences
[2] In case of nucleobase and sugar modifications being given In above Table 6:
A represents adenine;
U represents uracil;
C represents cytosine;
G represents guanine;
m represents a methyl modification at the 2' position of the sugar of the underlying nucleoside;
f represents a fluoro modification at the 2' position of the sugar of the underlying nucleoside
N/N"/N'" represents any RNA nucleobase;
N' represents any RNA nucleobase and is preferably complementary to N;
(ps) represents a phosphorothioate inter-nucleoside linkage;
i represents an inverted inter-nucleoside linkage, which can be either 3'-3', or 5'-5';
vp represents vinyl phosphonate;
mvp represents methyl vinyl phosphonate.

For each of the above constructs of Table 6, a ligand, such as a galnac ligand, is preferably attached at the 3' end of the sequence. Specifically for SEQ ID NOs 2251, 2252, 2253, this can be respectively illustrated as follows, where Galnac can represent any arrangement of Galnac attachment, preferably however a triantennary galnac attachment:

```
                                           (SEQ ID NO: 2326)
UUGGUGUGAGCAUUGCUUGCAAUGCUCACACCAA - Galnac (SEQ ID NO: 2327)
UUAUAAGAAAAUCAUCCUGAUGAUUUCUUAUAA - Galnac (SEQ ID NO: 2328)
UGGUUUCCAAUGAUGGAGCCAUCAUUGGAAACCA - Galnac.
```

Alternatively for SEQ ID NOs 2272 to 2273 as shown in above Table 6, the ligand, preferably Galnac, attachment can be to an internal non-terminal nucleoside, such as attachment to the nucleosides in the above sequences where the nucleobase is not shown as modified.

Example 7

This Example describes a structure-function relationship study of constructs comprising the nucleobase sequence of SEQ ID NO: 91.

FIG. 18 shows the constructs comprising the nucleobase sequence of SEQ ID NO: 91 which have been tested.

Tests have been performed in primary hepatocytes.

Human plateable 5 donor hepatocytes (Sekisui XenoTech, HPCH05+) are thawed in 45 mL of Human OptiThaw Hepatocyte media (Sekisui Xenotech, K8000), spun down at 200g for 5 minutes, and resuspended in 2×WEM complete (5% FBS, 2 uM Dexamethasone, Pen/Strep, 8 µg/mL human insulin, 4 mM GlutaMAX, 30 mM HEPES pH 7.4). 2×WEM complete consists of WEM (Gibco, A1217601) and 2x the Hepatocyte Plating Supplement Pack (Gibco, CM3000) with only 1×FBS. The hepatocytes are then plated on 6 well Collagen 1 coated plates (Gibco, A1142803) at 25,000 cell/well at 50 uL per well and allowed to recover and adhere for 4 hours at 37C.

After 4 hours, GalNac conjugated complexes are diluted to 2 uM in basal WEM and used to make a 2×, 7 step, 5 fold dilution series. 50 ul of each dilution is added to corresponding wells of the plated hepatocytes to make a final dilution series of 1-0.000064 uM in 1×WEM complete.

The cells are allowed to culture for 72 hours at 37 degrees without disruption before harvest and RNA isolation using the PureLink Pro 96 total RNA Purification Kit (Invitrogen, 12173011A) according to the manufacturer's protocol.

Figure 19B:
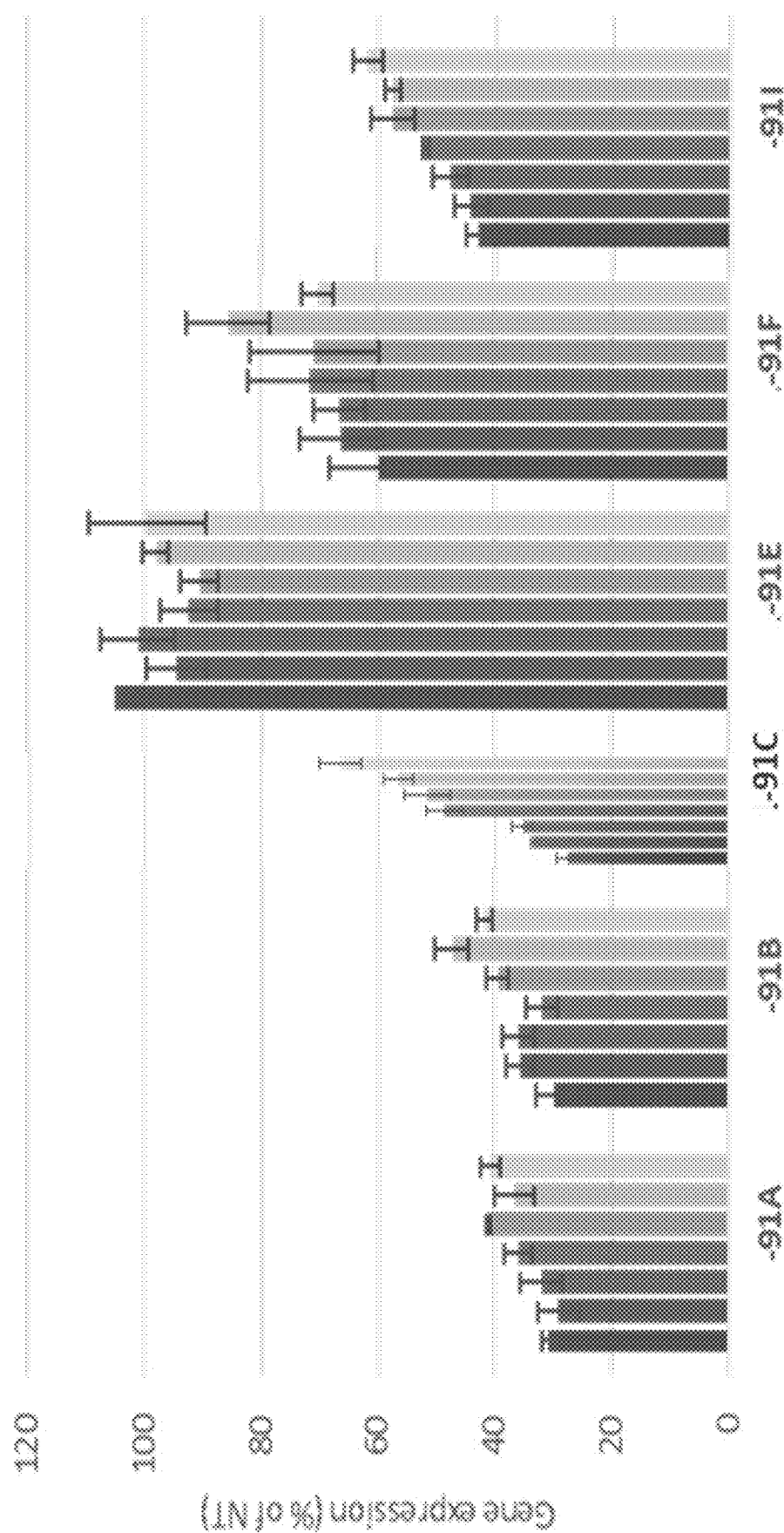
Figure 19C:
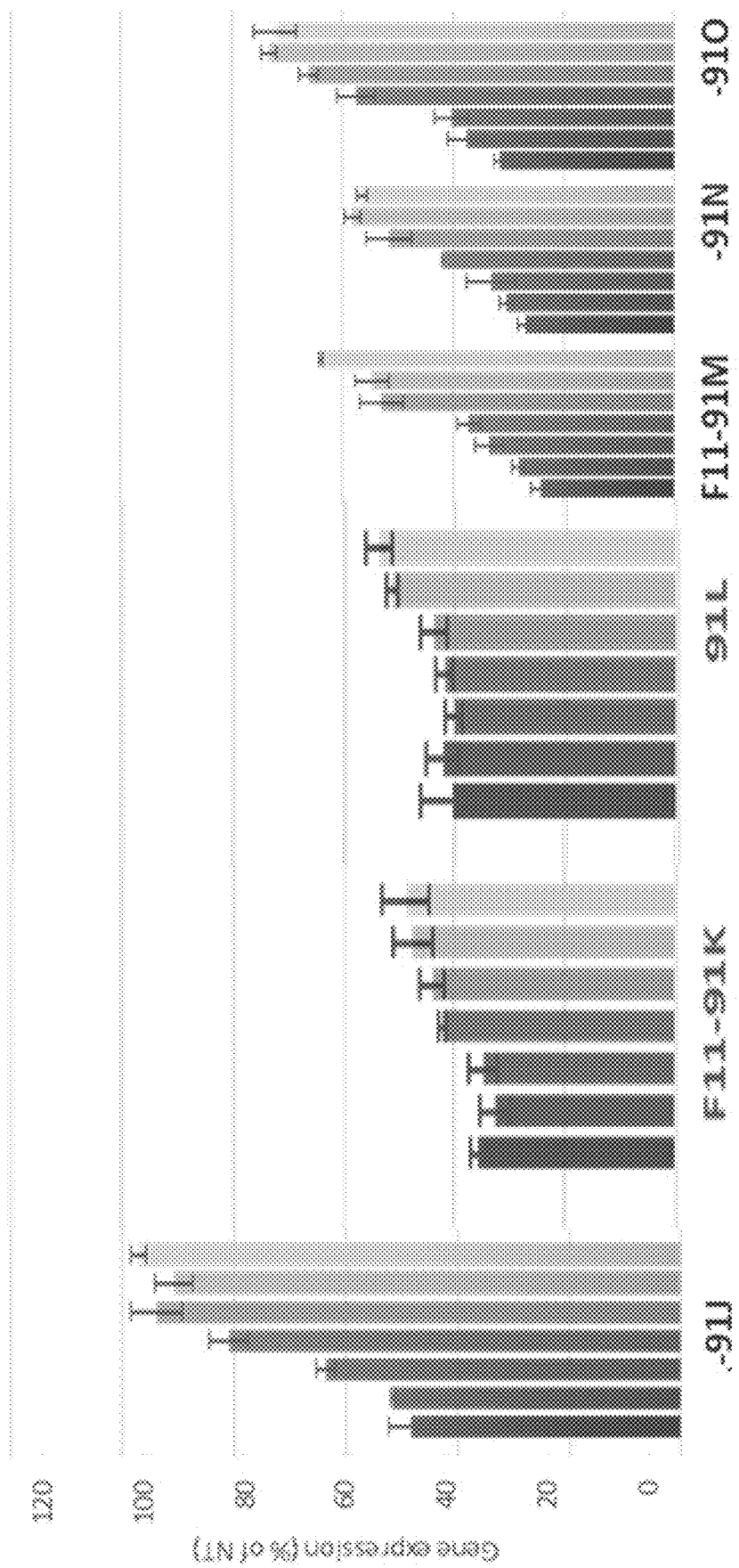
Figure 20A:
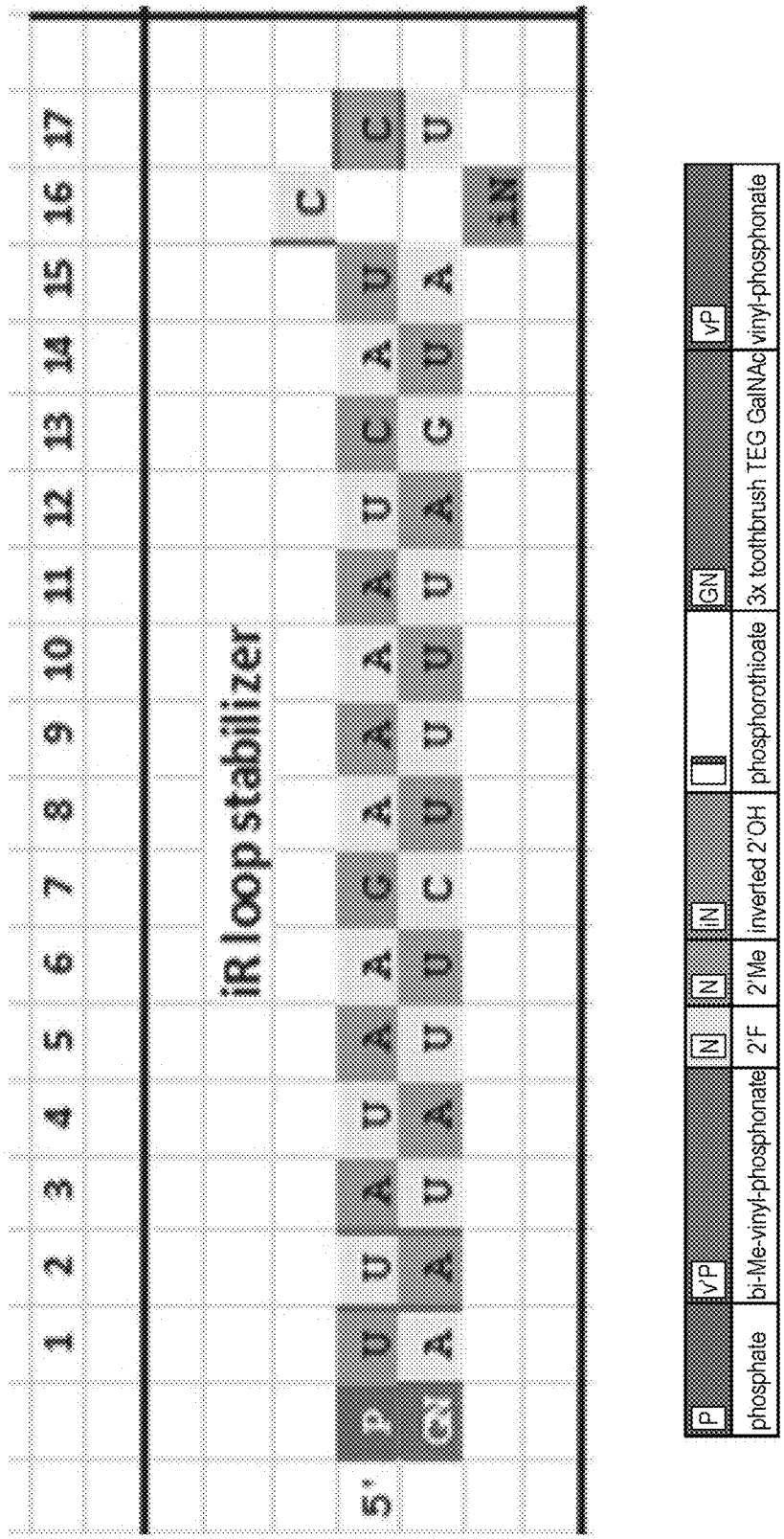
Figure 20B:
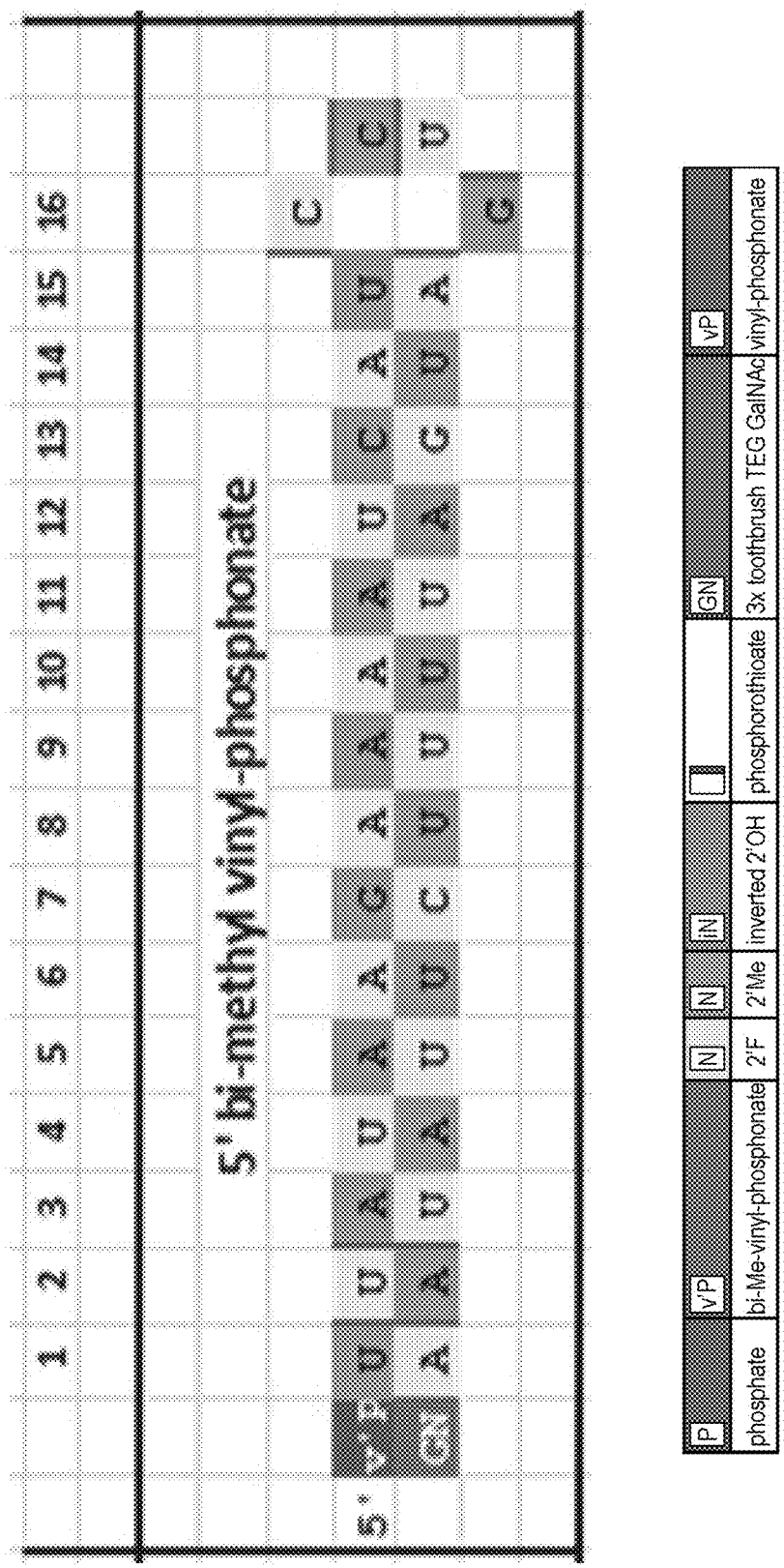
Figure 20C:
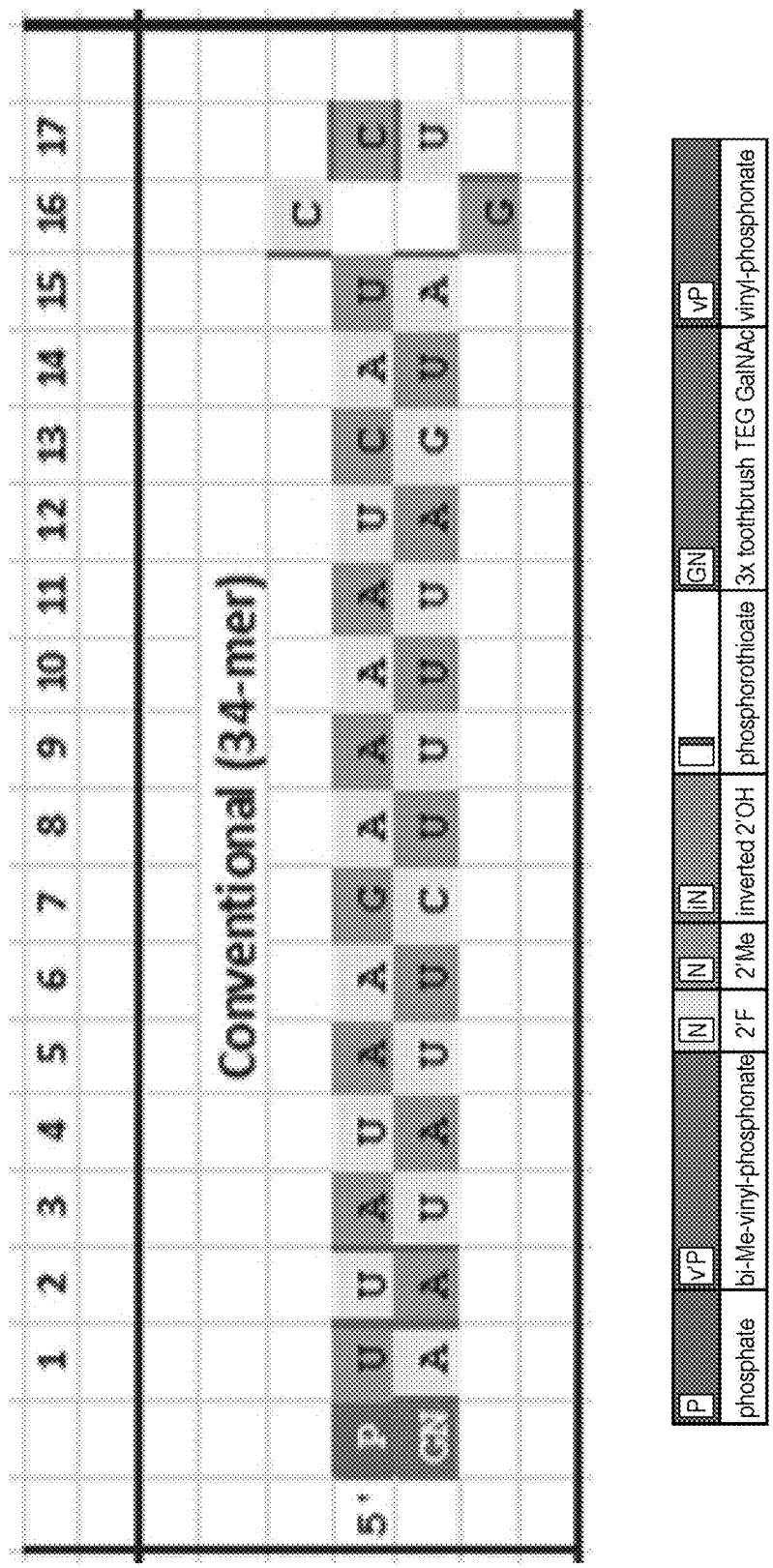
Figure 20D:
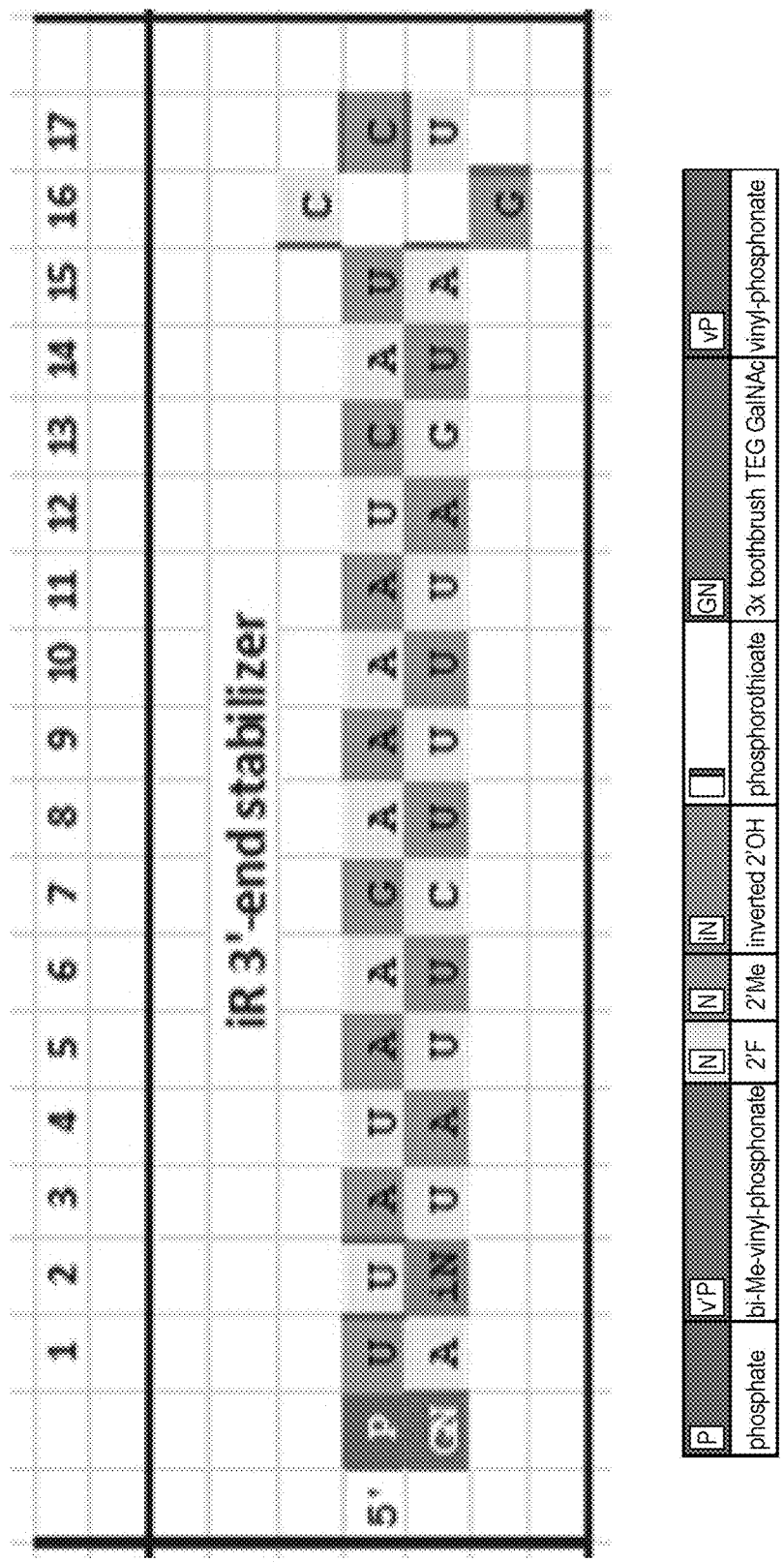
Figure 20E:
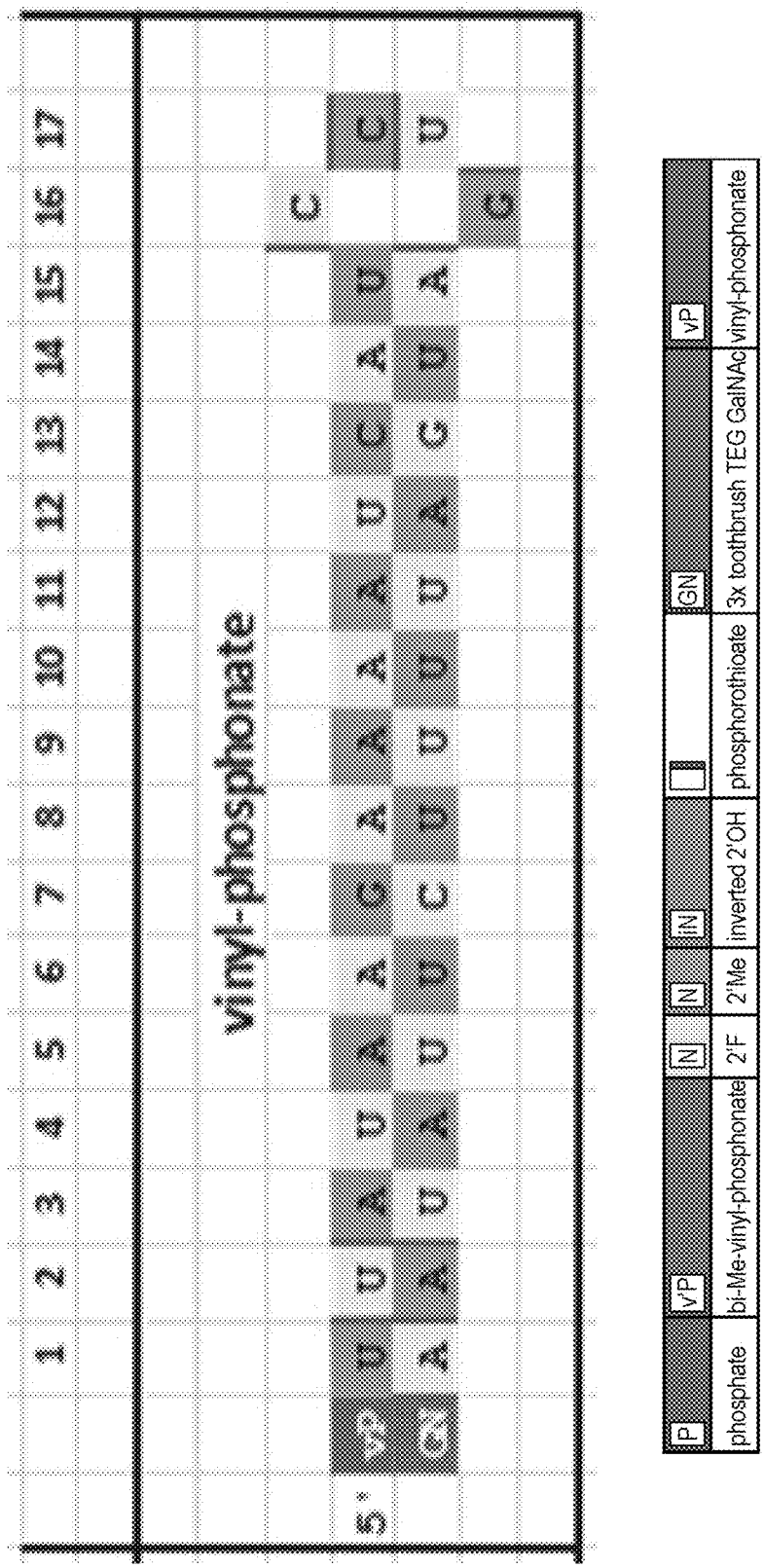
Figure 20F:
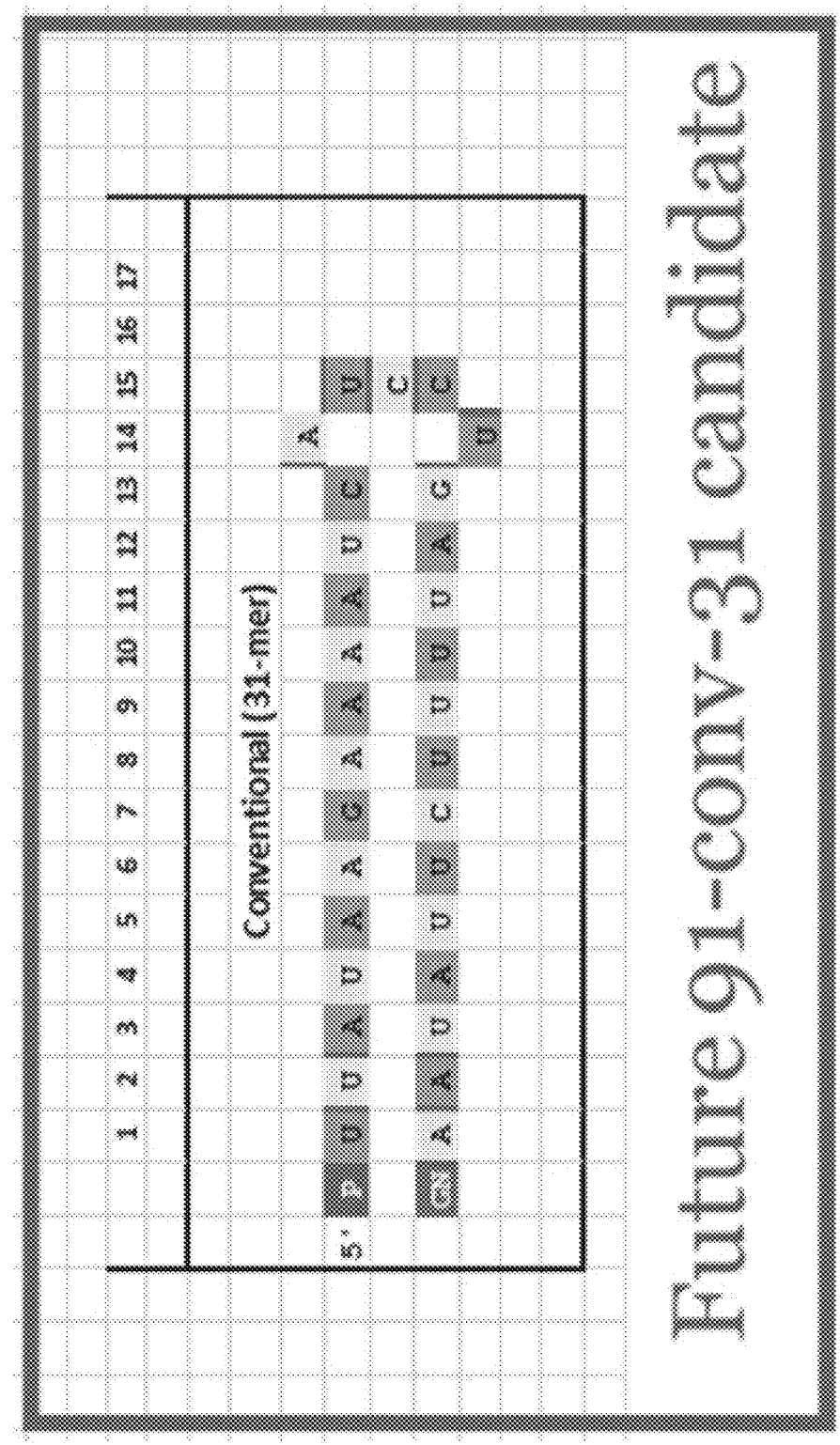
Figure 20G:
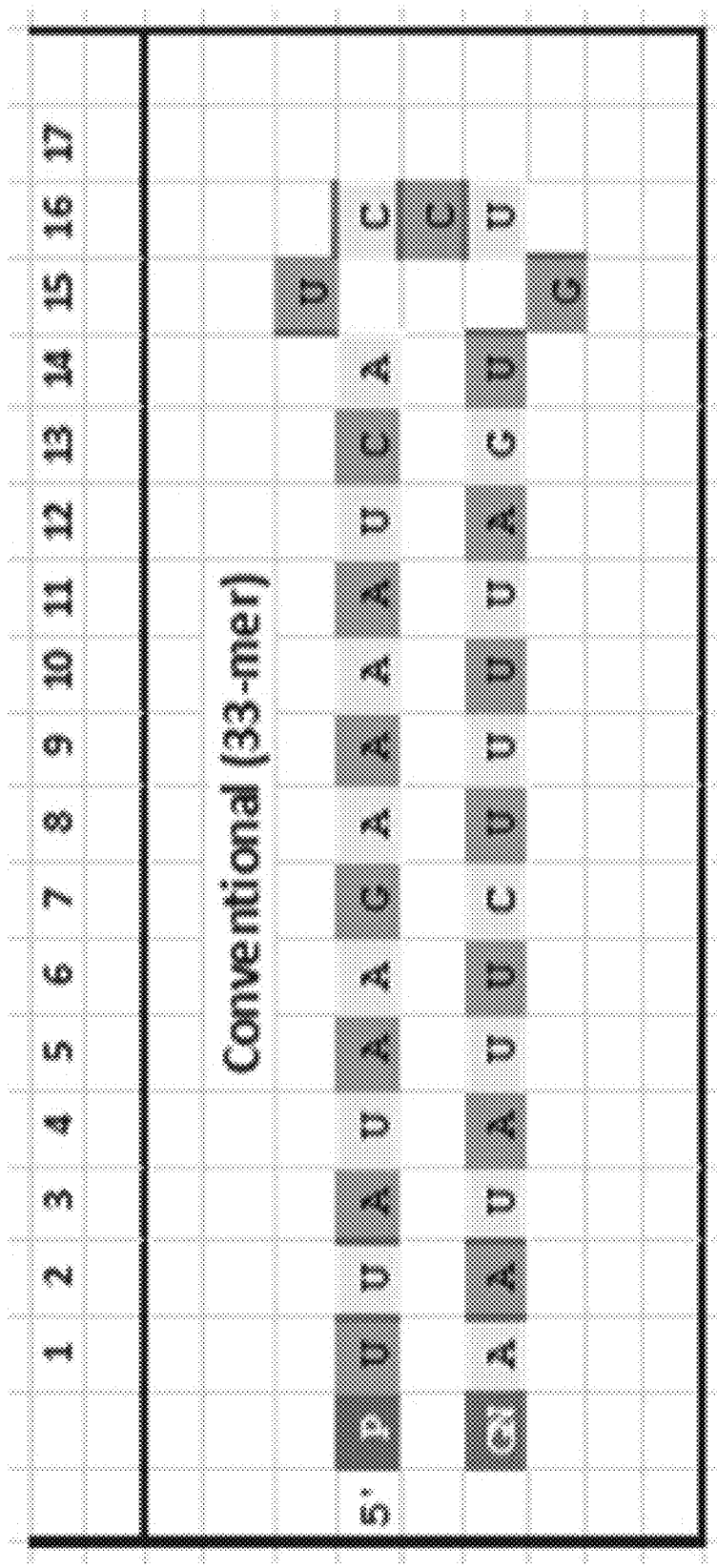

Results are shown in FIG. 19.

Based on these results, 7 molecules have been designed which are to be subjected to further analysis (see following Examples). These molecules are shown in FIG. 20. Performance data in primary hepatocytes are shown in FIG. 21.

Based on these data, three molecules have been tested in humanized mice; see Example 8 below.

Example 8

This Examples describes testing of the three molecules identified in Example 7 in humanized mice.

Table 7 below shows nucleobase sequences (SEQ ID NOs) and full modification information (construct NOs) of these three molecules.

| Designation as used herein | Nucleobase sequence | Structure of the construct |
|---|---|---|
| 91-conv-31 | UUAUAAGAAAAUCAUCCUGAU UUUCUUAUAA (SEQ ID NO: 2287) | /phos/mU*fU*mAfUmAfAmGfAmAfAmAfUmC* fA*mU*fC*mC*mU*fGmAfUmUfUmUfCmUfUm AfU*mA*fA*/3galnac/ (construct NO: 2290) |
| 91-vp | UUAUAAGAAAAUCAUCCUGAU GAUUUUCUUAUAA (SEQ ID NO: 2288) | /vp/mU/*fU*mAfUmAfAmGfAmAfAmAfUmCfA mU*fC*mC*fU*mG*fAmUfGmAfUmUfUmUfC mUfUmAfU*mA*fA*/3galnac/ (construct NO: 2291) |
| 91-conv-34 | (SEQ ID NO: 2288) | /phos/mU*fU*mAfUmAfAmGfAmAfAmAfUmCf AmU*fC*mC*fU*mG*fAmUfGmAfUmUfUmUfC mUfUmAfU*mA*fA*/3galnac/ (construct NO: 2292) |

In above Table 7

A represents adenine;
U represents uracil;
C represents cytosine;
G represents guanine;
m represents a methyl modification at the 2' position of the sugar of the underlying nucleoside;
f represents a fluoro modification at the 2' position of the sugar of the underlying nucleoside;
represents a phosphorothioate inter-nucleoside linkage;
vp represents vinyl phosphonate;
phos represents phosphonate; and
3galnac represents the toothbrush ligand defined herein above.

Figure 22:
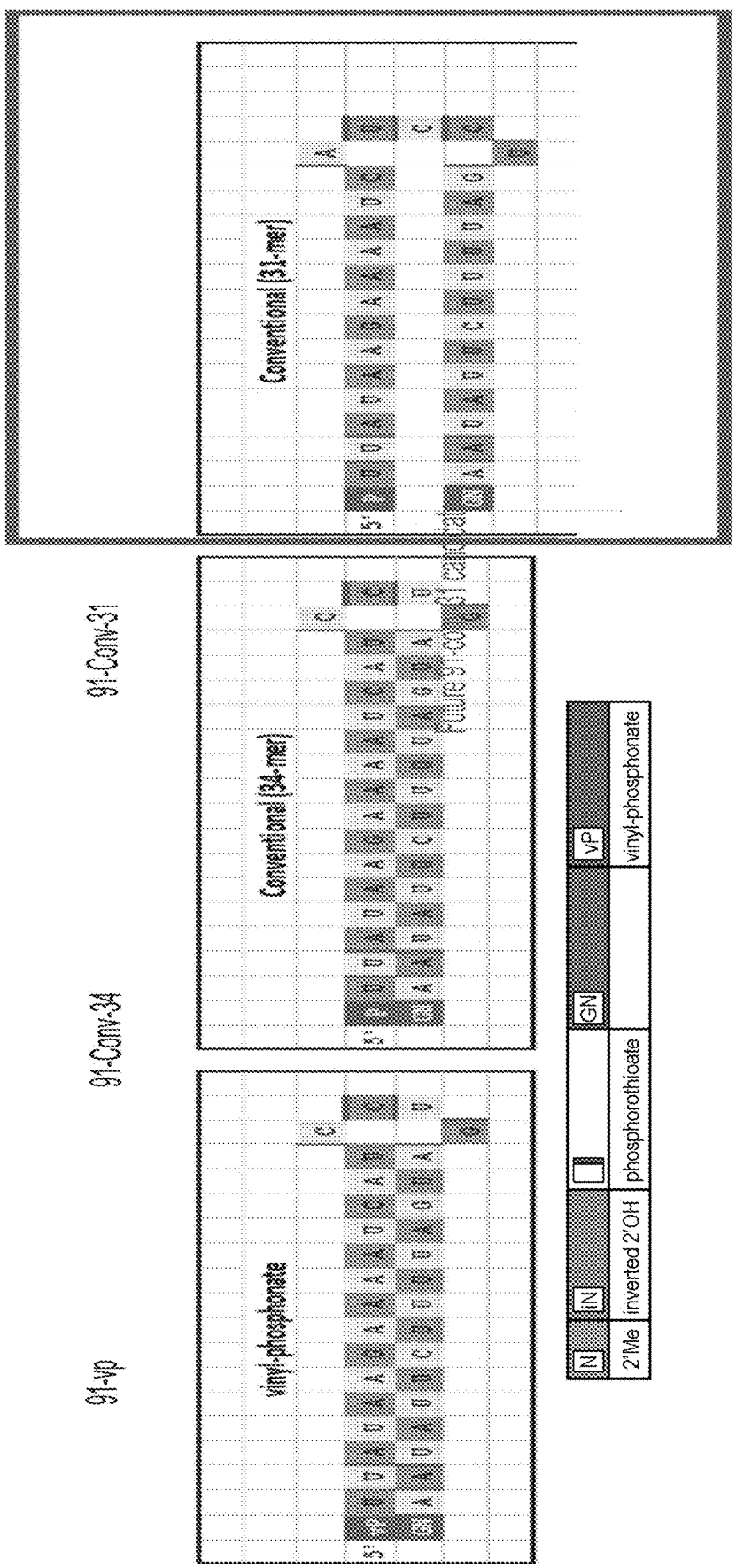
FIG. 22 shows the structures of three compounds tested in humanized mice: SEQ ID NOS 2363-2365, respectively, in order of appearance. See also Table 7, SEQ ID Nos. 2287-2288 and 2290-2292.
Figure 23:
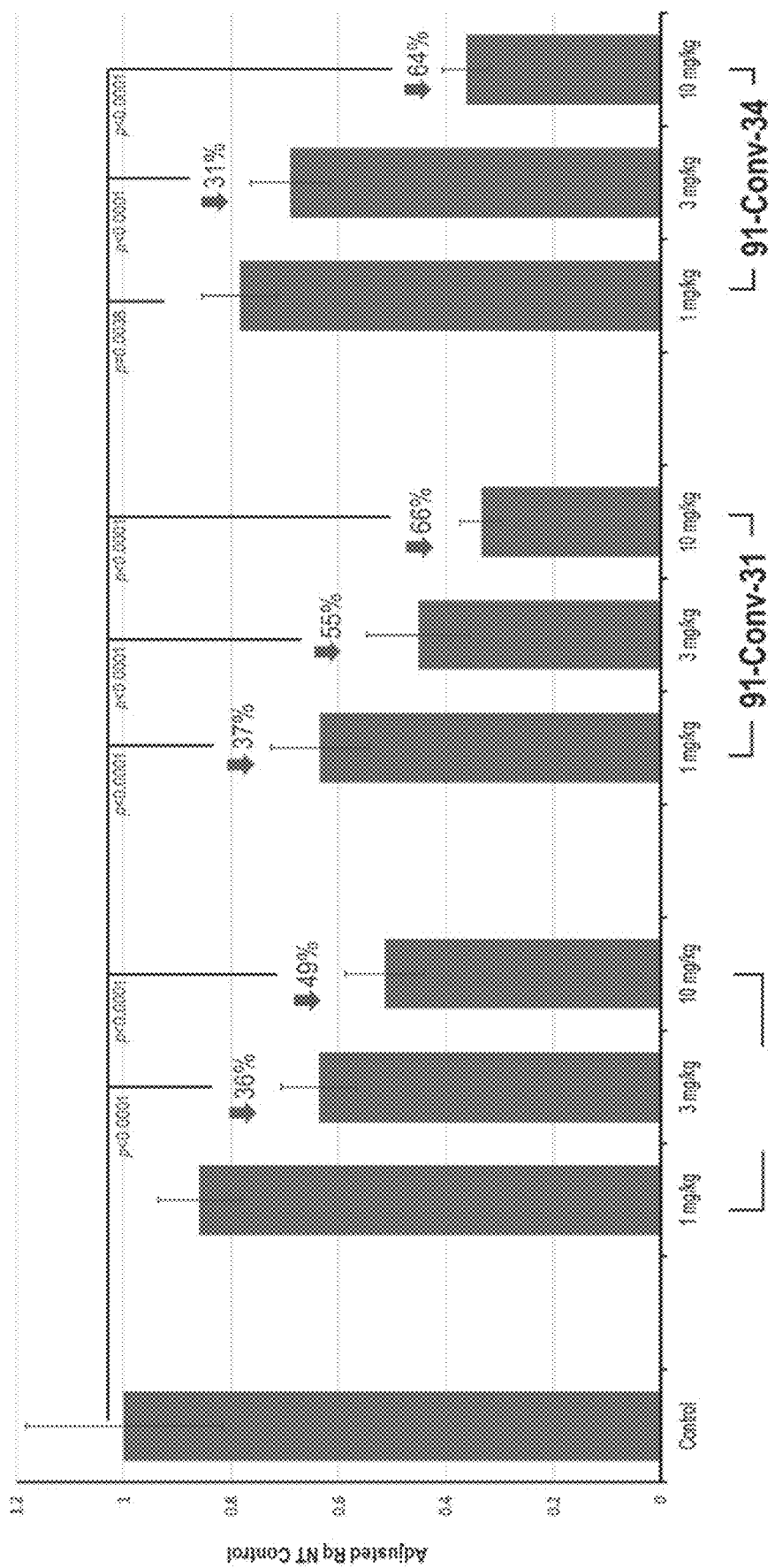
FIG. 23 shows the data obtained from testing in humanized mice.

FIG. 22 also shows the structures of these molecules. FIG. 23 shows performance of these molecules 5 days after administration.

Based on these results, the construct designated "91-Conv-31" (structure displayed in FIG. 22) has been selected for testing in non-human primates; see Example 9 below. Of note, this molecule is particularly short and comprises only a total of 31 nucleotides.

Example 9

This Example describes a Pharmacodynamics Study of construct designated "91-Conv-31" (structure displayed in FIG. 22) Following Single/Repeat Subcutaneous Injection to Cynomolgus Monkeys.

Material and Methods

For an overview of the study protocol, see FIG. 24. A more detailed account is given below.

Study Protocol

TABLE 8

Study Design

| Group/Phase | # of Males | Test Article | Target Dose Level (mg/animal) | TOTAL Target Dose Volume (mL) | Target Dose Concentration (mg/mL) | Dose Route |
|---|---|---|---|---|---|---|
| G1P1 | 3 naïve1 non-naïve | saline | — | 3.5 mL | — | SC |
| G2P1 | 3 naïve 1 non-naïve | STP122G | 3.5 (Target as 1 mg/kg) | 3.5 mL | 1 | SC |
| G3P1 | 3 naïve 1 non-naïve | STP122G | 10.5 (Target as 3 mg/kg) | 3.5 mL | 3 | SC |
| G4P1 | 3 naïve 1 non-naïve | STP122G | 35 (Target as 10 mg/kg) | 3.5 mL | 10 | SC |
| G5P1 | 3 naïve 1 non-naïve | STP122G | 10.5 (Target as 3 mg/kg) | 3.5 mL | 3 | SC |
| G6P1 | 3 naïve 1 non-naïve | STP122G | 10.5 (Target as 3 mg/kg) | 3.5 mL | 3 | SC |

Note:
1. Test article storage: Desiccated at room temperature, protected from light.
2. For SC group, animals will be fed on daily diet.
3. For all groups, saline will be used for vehicles
4. "STP122G" is an alternative designation for the preferred construct referred to as "91-Conv-31" herein

TABLE 9

Dose and Sample Collections

| | | Day −14 | Day 0 | Wk 1 | Wk 2 | Wk 3 | Wk 4 | Wk 5 | Wk 6 | Wk 7 | Wk 8 | Wk 9 | Wk 10 | Wk 11 | Wk 12 | Wk 13 |
|---|---|---|---|---|---|---|---|---|---|---|---|---|---|---|---|---|
| Dose | G1 | | QD | | | | | | | | | | | | | |
| | G2 | | QD | | | | | | | | | | | | | |
| | G3 | | QD | | | | | | | | | | | | | |
| | G4 | | QD | | | | | | | | | | | | | |
| | G5 | | QD | QD | | | | | | | | | | | | |
| | G6 | | QD | QD | QD | | | | | | | | | | | |
| 1 mL Whole Blood Sampling for Hematology | Group1-6 | Bl | | | Bl | Bl | Bl | Bl | Bl | | | | | | | Bl |
| 0.6 mL Serum Sampling for Clinical Chemistry | Group1-6 | Se | | | Se | Se | Se | Se | Se | | | | | | | Se |
| 1.7 mL Whole Blood Sampling for Coagulation | Group1-6 | Bl | Bl | Bl | Bl | Bl | Bl | Bl | Bl | Bl | Bl | Bl | Bl | Bl | Bl | Bl |

TABLE 9-continued

Dose and Sample Collections

|  |  | Day −14 | Day 0 | Wk 1 | Wk 2 | Wk 3 | Wk 4 | Wk 5 | Wk 6 | Wk 7 | Wk 8 | Wk 9 | Wk 10 | Wk 11 | Wk 12 | Wk 13 |
|---|---|---|---|---|---|---|---|---|---|---|---|---|---|---|---|---|
| 2.5 mL Plasma and 0.3 mL Serum Sampling for PD | Group1-6 | P, Se | P, Se | P, Se | P, Se | P, Se | P, Se | P, Se | P, Se | P, Se | P, Se | P, Se | P, Se | P, Se | P, Se | P, Se |

1. Wk1 point should be 7 days after Day 0; Wk2 point should be 14 days after Day 0.
2. Single dose with single compound, subcutaneous injection. For Day 0, Wk1 and Wk2, animals will be dosed after all samples collection.
3. (K2) EDTA as the anticoagulant for Hematology blood and sodium citrate as the anticoagulant for Coagulation blood and plasma.
4. Bl is short for blood; P is short for plasma; Se is short for Serum
5. Clinical Pathology Examination
Hematology
Erythrocyte count (RBC), Red cell distribution width (RDW), Hematocrit (HCT), Platelet count (PLT), Hemoglobin (HGB), Mean platelet volume (MPV), Mean corpuscular volume (MCV), Leukocyte counts (WBC), and Differential (absolute and percent), Mean corpuscular hemoglobin (MCH), Blood smear for possible cytology, Mean corpuscular hemoglobin concentration (MCHC), Absolute reticulocyte count (Retic).
Coagulation
Prothrombin time (PT), Activated partial thromboplastin time (APTT), Fibrinogen (FIB).
Clinical Chemistry
Alkaline Phosphatase (ALP), Total Protein (TP), Alanine Aminotransferase (ALT), Albumin (ALB), Aspartate Aminotransferase (AST), g-glutamyltransferase (GGT), Bilirubin, total (TBIL), Globulin (GLB), Phosphorus (P), Albumin/Globulin Ratio Creatinine (CRE), Sodium (Na), Glucose (GLU), Chloride (Cl), Calcium (Ca), Triglycerides (TG), Total Cholesterol (TCHO), Urea (UREA), Potassium (K), Creatine Kinase (CK), Lactate Dehydrogenase (LDH), Glutamate dehydrogenase (GLDH).

1 Study Information 1.1 Study Objective

The objective of this study is to determine the pharmacodynamics (PD) of the compound selected for this study, following a single/repeat subcutaneous (SC) administration in male cynomolgus monkeys.

1.2 Regulatory Compliance

This study is conducted in accordance with the Institutional Animal Care and Use Committee (IACUC) standard animal procedures along with the IACUC guidelines that are in compliance with the Animal Welfare Act and the Guide for the Care and Use of Laboratory Animals.

This study will be conducted in accordance with this protocol and protocol amendments (if applicable) and the associated study-specific procedures, and with applicable Standard Operating Procedures (SOPs) and generally recognized good laboratory practices. This study will not be considered within the scope of the Good Laboratory Practice regulations.

2 Test Article and Vehicle Information 2.1 Test Article

Compounds as specified further above.

| Storage Conditions: | Desiccate at room temperature, protected from light |
|---|---|
| Handling Instructions: | Standard laboratory precautions as defined in WuXi SOPs |
| Dose Preparation: | Doses will be prepared according to instructions provided by the sponsor. A copy of the instructions, as well as details of preparation, will be maintained in the study records. |
| Dose Solution Analysis Samples: |  |
| Disposition of Remaining Test Article Formulations: | Remaining formulations will be stored at 4°C. |
| Disposition of Remaining Test Article (dry powder or solid): | Remaining test article will be shipped back to sponsor or discarded 6 months after the final report is signed or at approval of Sponsor. |

3 Test System Identification 3.1 Animal Specifications

| Species | Cynomolgus monkeys (*Macaca fascicularis*) |
|---|---|
| Justification for Species Selection | This is an acceptable species to support PK studies for compounds intended to use in humans. |
| History of Dosing | 18 naïve animals and 6 non-naïve animals |
| Body Weight Range | 2-7 kg |
| Age | ≥2.0 years old |
| Sex | Male |
| Source | Hainan Jingang Laboratory Animal Co. Ltd and other permitted vendor |
| Address of Supplier | Nayangxintan Fucheng Town, Qiongshan District, Haikou Hainan Province, P.R. China |
| Method of Identification | Unique skin tattoo on chest |
| Justification for number of Animals | The number of animals in each group is the minimum number of animals necessary for assessment of interanimal variability. |
| Selection of Animals | 24 males will be selected. Animals will have undergone a physical examination for general health by a staff veterinarian. 24 males confirmed as being healthy, will be assigned to study. |
| Acclimation Period | Selected animals will be acclimated prior to the study. |

3.2 Animal Care 3.2.1 Environmental Conditions

The room(s) will be controlled and monitored for relative humidity (targeted mean range 40% to 70%, and any excursion from this range for more than 3 hours will be documented as a deviation) and temperature (targeted mean range 18° C. to 26° C., and any excursion from this range will be documented as a deviation) with 10 to 20 air changes/hour. The room will be on a 12-hour light/dark cycle except when interruptions are necessitated by study activities.

3.2.2 Housing

Animals will be pair-housed in cages that are in accordance with applicable animal welfare laws and regulations during acclimation period. The monkeys will be housed individually in cages during experiment.

Diet and Feeding

Animals will be fed twice daily. Stock monkeys will be fed approximately 120 grams of Certified Monkey Diet daily. These amounts can be adjusted as necessary based on food consumption of the group or body weight changes of an individual and/or changes in the certified diet.

Animals will be fasted overnight prior to blood collections for serum chemistry.

4.1.2 Body Weight

All animals will be weighted weekly. On dosing days, animals will be weighed on prior to dosing to determine the dose volume to be administered.

4.1.3 Blood Collection for Clinical Pathology

All blood samples will be collected from a peripheral vessel from restrained, non-sedated animals.

TABLE 10

Clinical Pathology Schedule

| Groups | Sample | Sampling Schedule[a] | Evaluations | Tube Type/Size Information | | Sample Volume approximately (minimum) |
|---|---|---|---|---|---|---|
| 1-6 | Blood | Once during pre-study; Weeks 2, 3, 4, 5, 6, and 13. | Hematology Serum Chemistry | $K_2$EDTA Plain with separating gel | 2 mL 3.5 mL | 2.0 mL (1.0 mL) 1.2 mL (1.1 mL) |
| | | Once during pre-study; Weekly. | Coagulation | Sodium Citrate | 2 mL | 1.7 mL (1.3 mL) |

[a]Blood sample may be collected from animals subjected to unscheduled euthanasia. Animals may not be fasted under that circumstance.

Drinking Water

Reverse osmosis (RO) water will be available to all animals, ad libitum.

3.2.3 Feed and Water Analyses

RO water is analyzed every three months and every batch of feed will be analyzed before use. Feed and water analyses will be maintained in the facility records.

3.2.4 Environmental Enrichment

Enrichment toys will be provided.

4 Administration of Dose Formulation

| | |
|---|---|
| Administration Route: | Subcutaneous injection via the dorsal area of the animals' thoracic regions. |
| Justification for the Dose Level: | Dose levels chosen to characterize the pharmacodynamics of test article in monkeys over the desired dose range and dosing frequencies. |
| Justification for the Administration Route: | This administration route is consistent with the proposed initial route of human administration. |
| Dose Administration: | The dose formulations will be administered per facility SOPs. SC ADMINISTRATION: SC injection site will be along the dorsal area of the animals' thoracic regions. For multiple or large doses, different sites will be used. When the injection site is altered, the location must be documented in the record. |

4.1 Observations and Examinations 4.1.1 Clinical Observations

Twice daily (approximately 9:30 a.m. and 4:00 p.m.), cage-side observations for general health and appearance will be conducted. Animals will be given physical examinations prior to study initiation to confirm animals' health. On dosing days, the animals will be observed at 2, 4 and 6-hours post-dosing. General condition, injection site, behavior, activity, excretion, respiration or other unusual observations noted throughout the study will be recorded in the raw data. When necessary, additional clinical observations will be performed and recorded. A staff veterinarian or veterinary technician will evaluate each animal if clinical observations demonstrate declining animal condition and the Study Director will be notified. The Study Director, or designee, will notify the Sponsor if warranted by the evaluation.

(1) Blood Collection for Hematology: Whole blood (at least 1.0 mL) will be collected from the animals into commercially available tubes with Potassium (K2) EDTA at room temperature (RT). The blood samples will be sent to clinical pathology lab in RT and tested for hematology parameters listed in the Table 9.

A blood smear will be prepared from each hematology sample. Blood smears will be labeled, stained, and stored. Blood smears may be read to investigate results of the hematology analyses. If additional examination of blood smears is deemed necessary, the smears may be subsequently evaluated and this evaluation will be described in a study plan amendment.

(2) Blood Collection for Coagulation Test: Approximately 1.7 mL blood will be collected into sodium citrate anticoagulation tubes at RT and sent to clinical pathology lab., The parameters listed in Table 9 will be performed to test coagulation function.

(3) Blood Collection for Clinical Chemistry: Whole blood samples (approximately 1.2 mL) without anticoagulant will be collected and held at RT and up-right for at least 30 minutes and sent to clinical pathology lab. The samples will be processed to serum, which will be examined for the parameters listed in Table 9.

4.1.4 Blood Collection for Pharmacodynamics (PD)

| | |
|---|---|
| Blood: | All blood samples will be collected from a peripheral vessel from restrained, non-sedated animals. |
| Animals: | All available, all groups |
| Post-Dose Blood volume: | Approximately 5.6 mL |
| Anticoagulant: | Sodium citrate |
| Frequency: | Refer to Table 9. Actual sample collection times will be recorded in the study records. For samples collected within the first hour of dosing, a ± 1 minute is acceptable. For the remaining time points, samples that are taken within 5% of the scheduled time are acceptable and will not be considered as protocol deviation. |
| Sample Processing: | For FXI ELISA: 2 mL Blood will be collected into a tube (Purchased from sponsor's required company) containing sodium citrate on wet ice. Then all the blood will be mixed upside down 4 times. Samples will be | centrifuged (1000 g for 20 minutes at 4° C.) and approximately 1 mL plasma will be transferred into two tubes quickly (approximately 0.50 mL per tube). One tube (labeled frozen plasma) should be frozen instantly in liquid nitrogen, then stored at −80° C.
For FXI Activity Assays: 3 mL Blood will be collected into a tube (Purchased from sponsor's required company) containing sodium citrate on wet ice. Then all the blood will be mixed upside down 4 times. Samples will be centrifuged (1660 g for 10 minutes at 4° C.) and approximately 1.5 mL plasma will be transferred into two labeled polypropylene micro-centrifuge tubes quickly (approximately 0.70 mL per tube). One tube (labeled frozen plasma) should be frozen instantly in liquid nitrogen, then stored at −80° C.. Another tube should be in a cool set to maintain 2-6° C. and shipped within 2-4 hours in 4° C. for analysis of Factor XI protein for Activity Assays.
For Serum: Whole blood samples (approximately 0.6 mL) without anticoagulant will be collected and held at RT and up-right for at least 30 minutes and then samples will be centrifuged (3200 g for 10 minutes at 4° C.) and approximately 0.3 mL serum will be transferred into tubes quickly. The tube should be frozen instantly in liquid nitrogen, then stored at −80° C. until analysis.

Protocol Amendments and Deviations

Changes to the approved protocol will be in the form of amendments approved by the Study Director and the Sponsor. Amendments will describe the protocol changes clearly and will include the effective date of the change and the justification for the change. The Study Director and Study Representative may authorize protocol changes by telephone or electronic means if he/she is not physically present at the time urgent or critical changes are required. Any authorization for such changes made as above must be documented appropriately and followed by a properly prepared written protocol amendment. The amendment must be signed and dated by the Study Director within 45 days of the effective date(s).

All deviations from the protocol and SOPs and the reasons of the deviations will be documented and acknowledged by the Study Director. The Sponsor's Representative will be informed promptly of the occurrence of any deviations that might affect the results of the study, and any corrective actions taken. Protocol and SOP deviations that could impact data interpretation will be included in the final report.

6 Archiving of Materials

Test article preparation, test article tracking, in-life data, protocol, protocol amendments (if applicable), and the original final report generated as a result of this study will be archived.

7 Statistical Analysis

The following section does not apply to data recorded on unscheduled occasions. Such data will be reported on an individual basis.

All numerical data will be subjected to calculation of group means and standard deviations by using Microsoft Excel software, unless otherwise stated hereafter. These descriptive statistics will be presented for each dataset of interest, as determined by the variable to be analyzed and the dataset classification variables (for example: sex, measurement occasion, and any other relevant variable that can be used to specify on which subdivision the descriptive statistics have to be reported).

If a dataset has less than three non-missing values in each group, then the following inferential data analysis will not be conducted. No inferential data analysis will be conducted on toxicokinetic parameters and semi-quantitative data such as: urine protein, urine pH, urine bilirubin, urine occult blood, urine glucose, and urine ketones.

Whenever there are more than two groups, the homogeneity of the group variances will be evaluated using Levene's test at the 0.05 significance level. If differences between group variances are not found to be significant (p>0.05), then a parametric one-way analysis of variance (ANOVA) will be performed. When significant differences among the means are indicated by ANOVA test (p<0.05), Dunnett's test will be used to perform the group mean comparisons between the control group and each treated group.

If Levene's test indicates heterogeneous group variances (p≤0.05) and the data set contains just positive values, log transformation will be performed. If transformed data still fail the test for homogeneity of variance (p≤0.05) or where the data contain zero and/or negative values, then the non-parametric Kruskal-Wallis test will be used to compare all considered groups. When Kruskal-Wallis test is significant (p≤0.05), Dunnett's test on ranks will be used to perform the pairwise group comparisons of interest.

Whenever there are only two groups to compare, Levene's test will be performed as described above but a two-sample t-test will replace the one-way ANOVA, a Wilcoxon rank-sum test will be performed instead of the Kruskal-Wallis and, no Dunnett's tests or Dunnett's tests on ranks will be performed.

Each pairwise group comparisons of interest will be conducted via a two-sided test at the 5% significance level. Significant results will be reported as either p≤0.001, p≤0.01, or p≤0.05, where p represents the observed probability.

Results

Figure 27A:
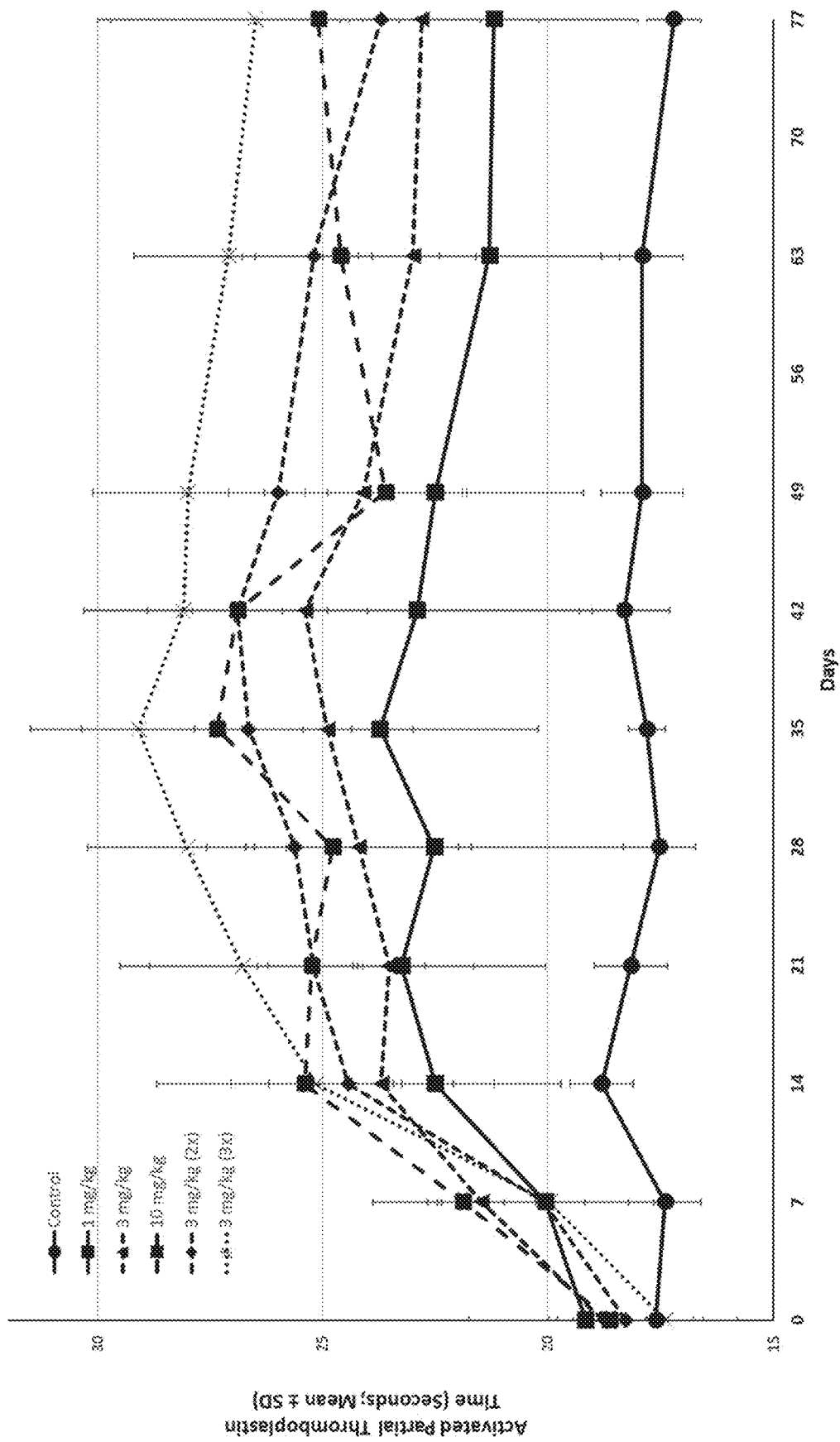
FIGS. 27a-27b provides the read-out of the results of the tests performed in FIG. 26.
Figure 27B:
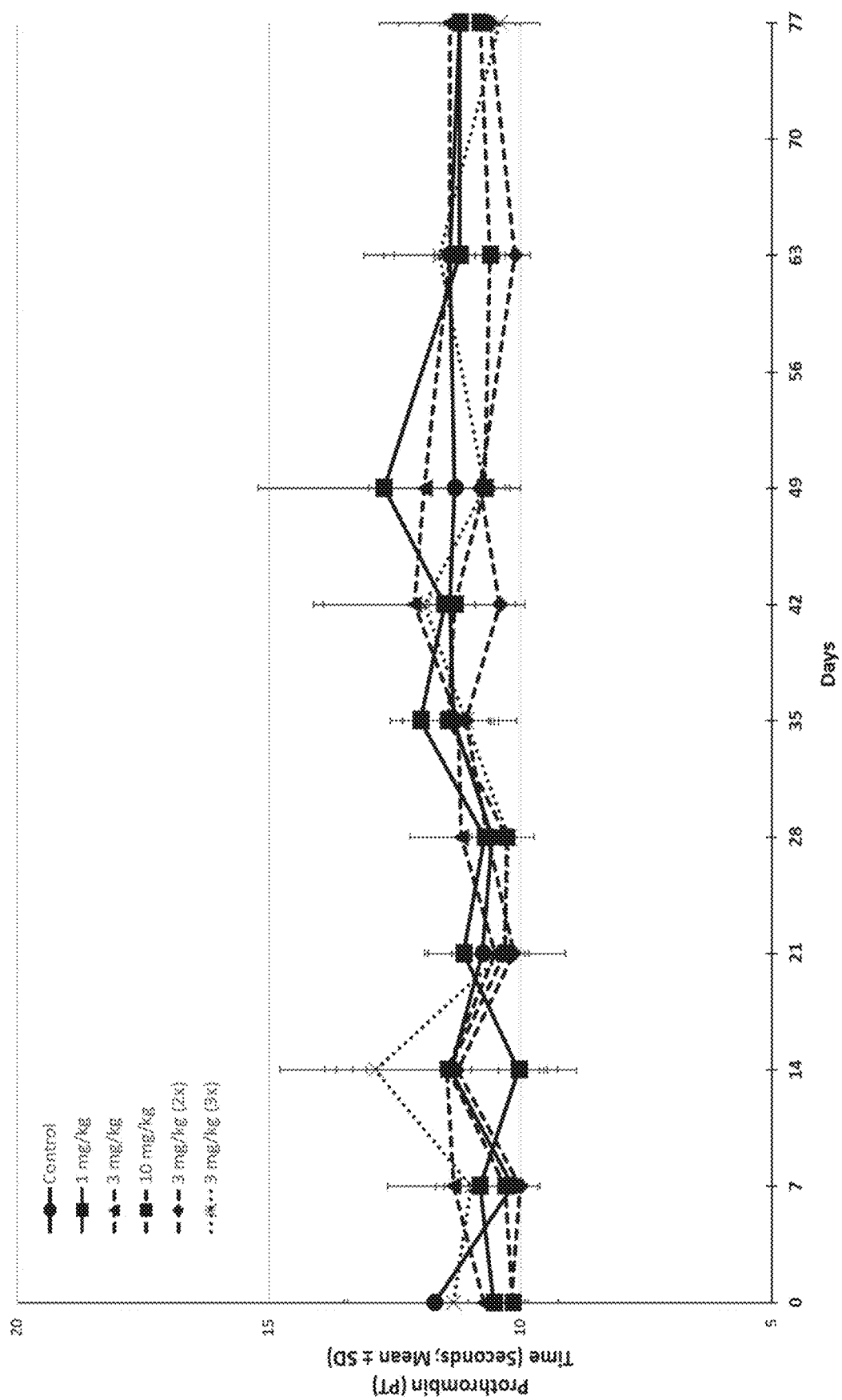

The results of the study are depicted in FIGS. 25, 27 and 28.

FIG. 25 shows performance of construct designated "91-Conv-31" (structure displayed in FIG. 22) in an in vivo study in terms of Factor XI activity knock-down. The effect of different dosages (expressed in mg/kg) and of single or multiple dosing at the beginning are shown and compared to a negative control (saline).

Efficient and unexpectedly long-lasting knock-down is apparent.

Figure 26:
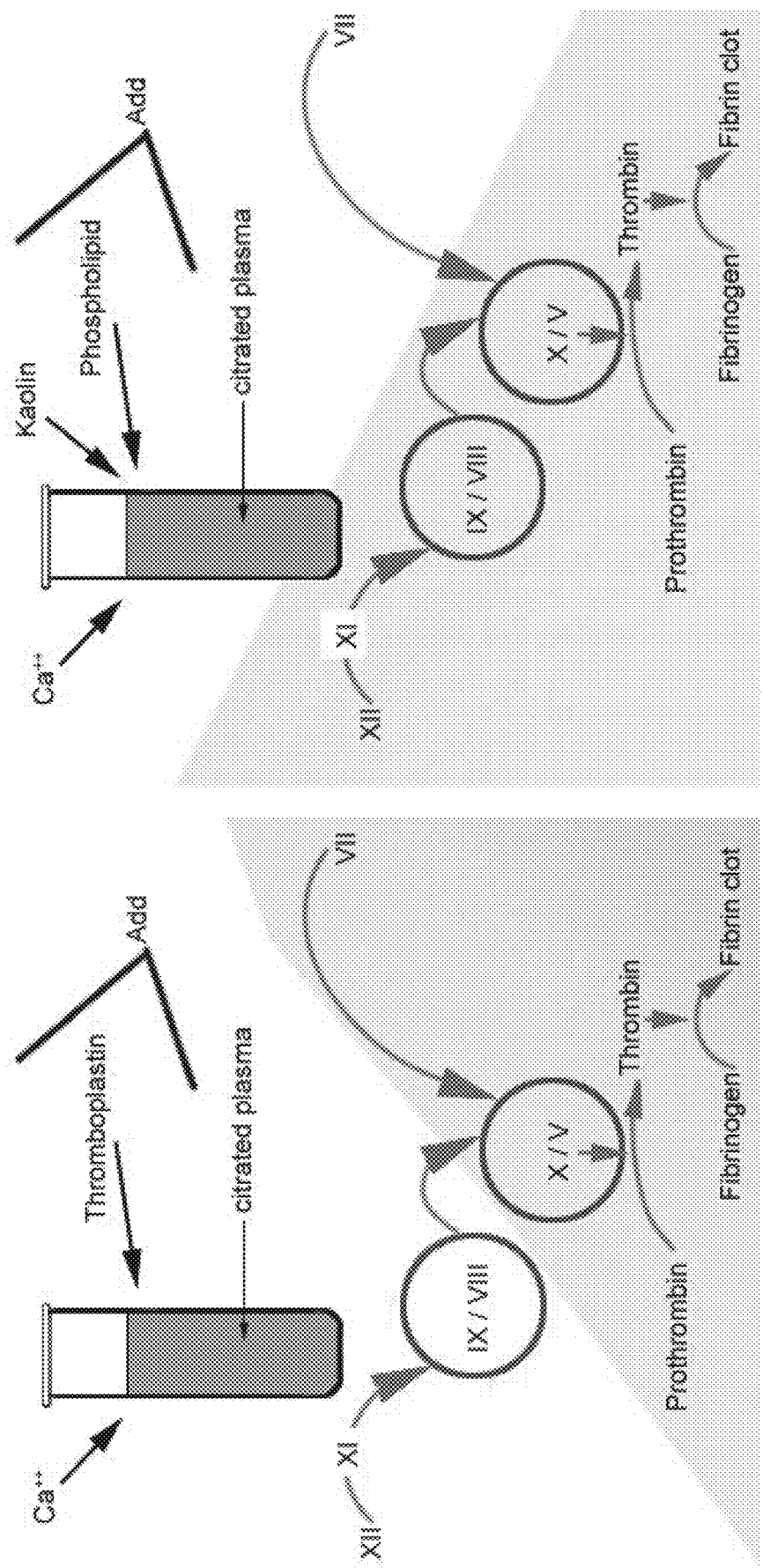
FIG. 26 shows the molecular mechanism underlying the tests for targeting specificity as performed in the course of an in vivo study.

FIG. 26 shows the molecular mechanism underlying the tests for targeting specificity as performed in the course of an in vivo study.

APTT stands for activated partial thromboplastin time. It measures the activity of intrinsic pathway of clotting that is impacted by factors like FXI. PT stands for prothrombin time which evaluates the integrity of extrinsic pathway of clotting that looks at the presence of factors like VII, V, X, prothrombin and fibrinogen.

FIG. 27 shows the read-out of the tests illustrated in FIG. 26.

The % FXI plasma activity (FIG. 25), together with APTT and PT data (FIG. 27) demonstrate that the molecule specifically targets FXI and does not have any off-target effect on the extrinsic clotting pathway.

FIG. 28 presents data demonstrating a lack of side effects. A panel liver function and hematology parameters have been assessed. In particular, no elevated levels of liver enzymes and no changes in hematology parameters could be found.

SEQUENCE LISTING (2366 sequences)

SEQ ID NO: 1 - RNA, 19 nt, Artificial Sequence
  Description of Artificial Sequence: Synthetic oligonucleotide
ucaaaaucuuaggugacuc

SEQ ID NO: 2 - RNA, 19 nt, Artificial Sequence
  Description of Artificial Sequence: Synthetic oligonucleotide
uauugauuuaaaaugccac

SEQ ID NO: 3 - RNA, 19 nt, Artificial Sequence
  Description of Artificial Sequence: Synthetic oligonucleotide
uagaaaucgcugcuguccu

SEQ ID NO: 4 - RNA, 19 nt, Artificial Sequence
  Description of Artificial Sequence: Synthetic oligonucleotide
uauaagaaaaucauccuga

SEQ ID NO: 5 - RNA, 19 nt, Artificial Sequence
  Description of Artificial Sequence: Synthetic oligonucleotide
uaaacaccguauuagggaa

SEQ ID NO: 6 - RNA, 19 nt, Artificial Sequence
  Description of Artificial Sequence: Synthetic oligonucleotide
uaaaucagugucaugguaa

SEQ ID NO: 7 - RNA, 19 nt, Artificial Sequence
  Description of Artificial Sequence: Synthetic oligonucleotide
uauacccgcuuucugccau

SEQ ID NO: 8 - RNA, 19 nt, Artificial Sequence
  Description of Artificial Sequence: Synthetic oligonucleotide
uagauguuuuaaggagaca

SEQ ID NO: 9 - RNA, 19 nt, Artificial Sequence
  Description of Artificial Sequence: Synthetic oligonucleotide
ugguaucuuggcuuucugg

SEQ ID NO: 10 - RNA, 19 nt, Artificial Sequence
  Description of Artificial Sequence: Synthetic oligonucleotide
ucucuguaucucuucuggc

SEQ ID NO: 11 - RNA, 19 nt, Artificial Sequence
  Description of Artificial Sequence: Synthetic oligonucleotide
uauggauuauuauuucuug

SEQ ID NO: 12 - RNA, 19 nt, Artificial Sequence
  Description of Artificial Sequence: Synthetic oligonucleotide
uagccagauuagaaagugc

SEQ ID NO: 13 - RNA, 19 nt, Artificial Sequence
  Description of Artificial Sequence: Synthetic oligonucleotide
uagcggacggcauuggugc

SEQ ID NO: 14 - RNA, 19 nt, Artificial Sequence
  Description of Artificial Sequence: Synthetic oligonucleotide
uauuucagauugauuuaaa

SEQ ID NO: 15 - RNA, 19 nt, Artificial Sequence
  Description of Artificial Sequence: Synthetic oligonucleotide
uuugucucuuaguuuucug

SEQ ID NO: 16 - RNA, 19 nt, Artificial Sequence
  Description of Artificial Sequence: Synthetic oligonucleotide
uagaacacugggaugcugu

SEQ ID NO: 17 - RNA, 19 nt, Artificial Sequence
  Description of Artificial Sequence: Synthetic oligonucleotide
uccacuugauauaagaaaa

SEQ ID NO: 18 - RNA, 19 nt, Artificial Sequence
  Description of Artificial Sequence: Synthetic oligonucleotide
ucauuuucuuacaaacacc

SEQ ID NO: 19 - RNA, 19 nt, Artificial Sequence
  Description of Artificial Sequence: Synthetic oligonucleotide
uuaaugcguguacugggca

SEQ ID NO: 20 - RNA, 19 nt, Artificial Sequence
  Description of Artificial Sequence: Synthetic oligonucleotide
uaggacagagggccucccg

SEQ ID NO: 21 - RNA, 19 nt, Artificial Sequence
  Description of Artificial Sequence: Synthetic oligonucleotide
ucaaccgggaugaugagug

SEQ ID NO: 22 - RNA, 19 nt, Artificial Sequence
  Description of Artificial Sequence: Synthetic oligonucleotide
ugacaaagauuucuuugag

SEQ ID NO: 23 - RNA, 19 nt, Artificial Sequence
  Description of Artificial Sequence: Synthetic oligonucleotide
ugaggaagcaugcuggcac

SEQ ID NO: 24 - RNA, 19 nt, Artificial Sequence
  Description of Artificial Sequence: Synthetic oligonucleotide
uggaaaaugucccuaauac

SEQ ID NO: 25 - RNA, 19 nt, Artificial Sequence
  Description of Artificial Sequence: Synthetic oligonucleotide
uuuaaguaacacuugcccu

SEQ ID NO: 26 - RNA, 19 nt, Artificial Sequence
  Description of Artificial Sequence: Synthetic oligonucleotide
ucaauaucauacccgcuuu

SEQ ID NO: 27 - RNA, 19 nt, Artificial Sequence
  Description of Artificial Sequence: Synthetic oligonucleotide
uaaauguaccacuugauau

SEQ ID NO: 28 - RNA, 19 nt, Artificial Sequence
  Description of Artificial Sequence: Synthetic oligonucleotide
uagaaaaucauccugaaaa

SEQ ID NO: 29 - RNA, 19 nt, Artificial Sequence
  Description of Artificial Sequence: Synthetic oligonucleotide
uuaacacuugcccuucccu

SEQ ID NO: 30 - RNA, 19 nt, Artificial Sequence
  Description of Artificial Sequence: Synthetic oligonucleotide
uagcauuuucuuacaaaca

SEQ ID NO: 31 - RNA, 19 nt, Artificial Sequence
  Description of Artificial Sequence: Synthetic oligonucleotide
ucaaacaccguauuaggga

SEQ ID NO: 32 - RNA, 19 nt, Artificial Sequence
  Description of Artificial Sequence: Synthetic oligonucleotide
uagcggcuguuaauaucca

SEQ ID NO: 33 - RNA, 19 nt, Artificial Sequence
  Description of Artificial Sequence: Synthetic oligonucleotide
ugagcggcuguuaauaucc

SEQ ID NO: 34 - RNA, 19 nt, Artificial Sequence
  Description of Artificial Sequence: Synthetic oligonucleotide
ugagacaaagauuucuuug

SEQ ID NO: 35 - RNA, 19 nt, Artificial Sequence
  Description of Artificial Sequence: Synthetic oligonucleotide
uuggguuauuuuauguccu

SEQ ID NO: 36 - RNA, 19 nt, Artificial Sequence
  Description of Artificial Sequence: Synthetic oligonucleotide
ugagccaugacacugucga

SEQ ID NO: 37 - RNA, 19 nt, Artificial Sequence
  Description of Artificial Sequence: Synthetic oligonucleotide
ucagauuagaaagugcaca

SEQ ID NO: 38 - RNA, 19 nt, Artificial Sequence
  Description of Artificial Sequence: Synthetic oligonucleotide
uagaauacccagaaaucgc

SEQ ID NO: 39 - RNA, 19 nt, Artificial Sequence
  Description of Artificial Sequence: Synthetic oligonucleotide
ucagauguuuuaaggagac

SEQ ID NO: 40 - RNA, 19 nt, Artificial Sequence
  Description of Artificial Sequence: Synthetic oligonucleotide
uuguauccagagaugccuc

SEQ ID NO: 41 - RNA, 19 nt, Artificial Sequence
  Description of Artificial Sequence: Synthetic oligonucleotide
ugagucacacauucaccag

SEQ ID NO: 42 - RNA, 19 nt, Artificial Sequence
  Description of Artificial Sequence: Synthetic oligonucleotide
ucaaagaaagauguguccu

SEQ ID NO: 43 - RNA, 19 nt, Artificial Sequence
  Description of Artificial Sequence: Synthetic oligonucleotide
uaccacuugauauaagaaa

SEQ ID NO: 44 - RNA, 19 nt, Artificial Sequence
  Description of Artificial Sequence: Synthetic oligonucleotide
uaagaaagcuuuaaguaac

SEQ ID NO: 45 - RNA, 19 nt, Artificial Sequence
  Description of Artificial Sequence: Synthetic oligonucleotide
uuuauuucagauugauuua

SEQ ID NO: 46 - RNA, 19 nt, Artificial Sequence
  Description of Artificial Sequence: Synthetic oligonucleotide
uuggugugagcauugcuug

SEQ ID NO: 47 - RNA, 19 nt, Artificial Sequence
  Description of Artificial Sequence: Synthetic oligonucleotide
uaucauccugaaaagaccu

SEQ ID NO: 48 - RNA, 19 nt, Artificial Sequence
  Description of Artificial Sequence: Synthetic oligonucleotide
ugugagcauugcuugaaag

SEQ ID NO: 49 - RNA, 19 nt, Artificial Sequence
  Description of Artificial Sequence: Synthetic oligonucleotide
ucuguaucucuucuggcac

SEQ ID NO: 50 - RNA, 19 nt, Artificial Sequence
  Description of Artificial Sequence: Synthetic oligonucleotide
uaccuuaauguguauccag

SEQ ID NO: 51 - RNA, 19 nt, Artificial Sequence
  Description of Artificial Sequence: Synthetic oligonucleotide
uaucauggauuauuauuuc

SEQ ID NO: 52 - RNA, 19 nt, Artificial Sequence
  Description of Artificial Sequence: Synthetic oligonucleotide
ucaaagauuucuuugagau

SEQ ID NO: 53 - RNA, 19 nt, Artificial Sequence
  Description of Artificial Sequence: Synthetic oligonucleotide
ugaaguauuuuaguuggag

SEQ ID NO: 54 - RNA, 19 nt, Artificial Sequence
  Description of Artificial Sequence: Synthetic oligonucleotide
uagauugauuuaaaaugcc

SEQ ID NO: 55 - RNA, 19 nt, Artificial Sequence
  Description of Artificial Sequence: Synthetic oligonucleotide
uggguaucuuggcuuucug

SEQ ID NO: 56 - RNA, 19 nt, Artificial Sequence
  Description of Artificial Sequence: Synthetic oligonucleotide
uaggagacaaagauuucuu

SEQ ID NO: 57 - RNA, 19 nt, Artificial Sequence
  Description of Artificial Sequence: Synthetic oligonucleotide
ugucaugguaaaaugaaga

SEQ ID NO: 58 - RNA, 19 nt, Artificial Sequence
  Description of Artificial Sequence: Synthetic oligonucleotide
uauauccaguucuucuccc

SEQ ID NO: 59 - RNA, 19 nt, Artificial Sequence
  Description of Artificial Sequence: Synthetic oligonucleotide
uaauauccaguucuucucc

SEQ ID NO: 60 - RNA, 19 nt, Artificial Sequence
  Description of Artificial Sequence: Synthetic oligonucleotide
ucugugguuuccaguuuca

SEQ ID NO: 61 - RNA, 19 nt, Artificial Sequence
  Description of Artificial Sequence: Synthetic oligonucleotide
uagauuagaaagugcacag

SEQ ID NO: 62 - RNA, 19 nt, Artificial Sequence
  Description of Artificial Sequence: Synthetic oligonucleotide
uagaaaucagugucauggu

SEQ ID NO: 63 - RNA, 19 nt, Artificial Sequence
  Description of Artificial Sequence: Synthetic oligonucleotide
uuggauuauuauuucuuga

SEQ ID NO: 64 - RNA, 19 nt, Artificial Sequence
  Description of Artificial Sequence: Synthetic oligonucleotide
uccagauuagaaagugcac

SEQ ID NO: 65 - RNA, 19 nt, Artificial Sequence
  Description of Artificial Sequence: Synthetic oligonucleotide
ucucauuauccauuuuaca

SEQ ID NO: 66 - RNA, 19 nt, Artificial Sequence
  Description of Artificial Sequence: Synthetic oligonucleotide
uuugggccauuccugggaa

SEQ ID NO: 67 - RNA, 19 nt, Artificial Sequence
  Description of Artificial Sequence: Synthetic oligonucleotide
uugggcuugauuuuggugg

SEQ ID NO: 68 - RNA, 19 nt, Artificial Sequence
  Description of Artificial Sequence: Synthetic oligonucleotide
ucagauugauuuaaaaugc

SEQ ID NO: 69 - RNA, 19 nt, Artificial Sequence
  Description of Artificial Sequence: Synthetic oligonucleotide
uaagcaaccgggaugauga

SEQ ID NO: 70 - RNA, 19 nt, Artificial Sequence
  Description of Artificial Sequence: Synthetic oligonucleotide
ucuuaauguguauccagag

SEQ ID NO: 71 - RNA, 19 nt, Artificial Sequence
  Description of Artificial Sequence: Synthetic oligonucleotide
uguaauucacugugguuuc

SEQ ID NO: 72 - RNA, 19 nt, Artificial Sequence
  Description of Artificial Sequence: Synthetic oligonucleotide
uacauuucuaucuccuuug

SEQ ID NO: 73 - RNA, 19 nt, Artificial Sequence
  Description of Artificial Sequence: Synthetic oligonucleotide
ucacugguuuccaaugaug

SEQ ID NO: 74 - RNA, 19 nt, Artificial Sequence
  Description of Artificial Sequence: Synthetic oligonucleotide
ugaaucuguguaauucacu

SEQ ID NO: 75 - RNA, 19 nt, Artificial Sequence
  Description of Artificial Sequence: Synthetic oligonucleotide
uguccuauucacucuuggc

SEQ ID NO: 76 - RNA, 19 nt, Artificial Sequence
  Description of Artificial Sequence: Synthetic oligonucleotide
uagcauugcuugaaagaau

SEQ ID NO: 77 - RNA, 19 nt, Artificial Sequence
  Description of Artificial Sequence: Synthetic oligonucleotide
uaauacccagaaaucgcug

SEQ ID NO: 78 - RNA, 19 nt, Artificial Sequence
  Description of Artificial Sequence: Synthetic oligonucleotide
uauuauuauuucuugaacc

SEQ ID NO: 79 - RNA, 19 nt, Artificial Sequence
  Description of Artificial Sequence: Synthetic oligonucleotide
uaaguauuuuaguuggaga

SEQ ID NO: 80 - RNA, 19 nt, Artificial Sequence
  Description of Artificial Sequence: Synthetic oligonucleotide
ugaauccaguccacguacu

SEQ ID NO: 81 - RNA, 19 nt, Artificial Sequence
  Description of Artificial Sequence: Synthetic oligonucleotide
uagacaaagauuucuuuga

SEQ ID NO: 82 - RNA, 19 nt, Artificial Sequence
  Description of Artificial Sequence: Synthetic oligonucleotide
uacaggauuucagugaaaa

SEQ ID NO: 83 - RNA, 19 nt, Artificial Sequence
  Description of Artificial Sequence: Synthetic oligonucleotide
uaacaaggcaauaucauac

SEQ ID NO: 84 - RNA, 19 nt, Artificial Sequence
  Description of Artificial Sequence: Synthetic oligonucleotide
uaaggcaauaucauacccg

SEQ ID NO: 85 - RNA, 19 nt, Artificial Sequence
  Description of Artificial Sequence: Synthetic oligonucleotide
uauacccagaaaucgcugc

SEQ ID NO: 86 - RNA, 19 nt, Artificial Sequence
  Description of Artificial Sequence: Synthetic oligonucleotide
ugauugauuuaaaaugcca

SEQ ID NO: 87 - RNA, 19 nt, Artificial Sequence
  Description of Artificial Sequence: Synthetic oligonucleotide
uccuauucacucuuggcag

SEQ ID NO: 88 - RNA, 19 nt, Artificial Sequence
  Description of Artificial Sequence: Synthetic oligonucleotide
uguagacacgcaaaaucuu

SEQ ID NO: 89 - RNA, 19 nt, Artificial Sequence
  Description of Artificial Sequence: Synthetic oligonucleotide
uugaguuuucuccagaauc

SEQ ID NO: 90 - RNA, 19 nt, Artificial Sequence
  Description of Artificial Sequence: Synthetic oligonucleotide
uauuucuuugagauucuuu

SEQ ID NO: 91 - RNA, 19 nt, Artificial Sequence
  Description of Artificial Sequence: Synthetic oligonucleotide
uuauaagaaaaucauccug

SEQ ID NO: 92 - RNA, 19 nt, Artificial Sequence
  Description of Artificial Sequence: Synthetic oligonucleotide
uaaaaucuuaggugacucu

SEQ ID NO: 93 - RNA, 19 nt, Artificial Sequence
  Description of Artificial Sequence: Synthetic oligonucleotide
uacacugggaugcugugcc

SEQ ID NO: 94 - RNA, 19 nt, Artificial Sequence
  Description of Artificial Sequence: Synthetic oligonucleotide
uugcacaggauuucaguga

SEQ ID NO: 95 - RNA, 19 nt, Artificial Sequence
  Description of Artificial Sequence: Synthetic oligonucleotide
uauacaagccagauuagaa

SEQ ID NO: 96 - RNA, 19 nt, Artificial Sequence
  Description of Artificial Sequence: Synthetic oligonucleotide
uugugguuuccaguuucaa

SEQ ID NO: 97 - RNA, 19 nt, Artificial Sequence
  Description of Artificial Sequence: Synthetic oligonucleotide
uugcccuucccuucguugc

SEQ ID NO: 98 - RNA, 19 nt, Artificial Sequence
  Description of Artificial Sequence: Synthetic oligonucleotide
uaaaaucauccugaaaaga

SEQ ID NO: 99 - RNA, 19 nt, Artificial Sequence
  Description of Artificial Sequence: Synthetic oligonucleotide
uccaagaaaucagugucau

SEQ ID NO: 100 - RNA, 19 nt, Artificial Sequence
  Description of Artificial Sequence: Synthetic oligonucleotide
uggcauaugggucguugag

SEQ ID NO: 101 - RNA, 19 nt, Artificial Sequence
  Description of Artificial Sequence: Synthetic oligonucleotide
uagaaucuguguaauucac

SEQ ID NO: 102 - RNA, 19 nt, Artificial Sequence
  Description of Artificial Sequence: Synthetic oligonucleotide
uauccaguccacguacucg

SEQ ID NO: 103 - RNA, 19 nt, Artificial Sequence
  Description of Artificial Sequence: Synthetic oligonucleotide
uccucuguaucucuucugg

SEQ ID NO: 104 - RNA, 19 nt, Artificial Sequence
  Description of Artificial Sequence: Synthetic oligonucleotide
ugcacaggauuucagugaa

SEQ ID NO: 105 - RNA, 19 nt, Artificial Sequence
  Description of Artificial Sequence: Synthetic oligonucleotide
uguaaaaugaagaauggca

SEQ ID NO: 106 - RNA, 19 nt, Artificial Sequence
  Description of Artificial Sequence: Synthetic oligonucleotide
ugucguugagaaucugugu

SEQ ID NO: 107 - RNA, 19 nt, Artificial Sequence
  Description of Artificial Sequence: Synthetic oligonucleotide
ugcaacaauauccaguucu

SEQ ID NO: 108 - RNA, 19 nt, Artificial Sequence
  Description of Artificial Sequence: Synthetic oligonucleotide
ucagcggacggcauuggug

SEQ ID NO: 109 - RNA, 19 nt, Artificial Sequence
  Description of Artificial Sequence: Synthetic oligonucleotide
ugaaagcuuuaaguaacac

SEQ ID NO: 110 - RNA, 19 nt, Artificial Sequence
  Description of Artificial Sequence: Synthetic oligonucleotide
ugcaguguuucuguaacac

SEQ ID NO: 111 - RNA, 19 nt, Artificial Sequence
  Description of Artificial Sequence: Synthetic oligonucleotide
ugagaaucuguguaauuca

SEQ ID NO: 112 - RNA, 19 nt, Artificial Sequence
  Description of Artificial Sequence: Synthetic oligonucleotide
uuccaguccacguacucga

SEQ ID NO: 113 - RNA, 19 nt, Artificial Sequence
  Description of Artificial Sequence: Synthetic oligonucleotide
uugugagcauugcuugaaa

SEQ ID NO: 114 - RNA, 19 nt, Artificial Sequence
  Description of Artificial Sequence: Synthetic oligonucleotide
uccgggaugaugagugcag

SEQ ID NO: 115 - RNA, 19 nt, Artificial Sequence
  Description of Artificial Sequence: Synthetic oligonucleotide
uccacuuuaucgagcuucg

SEQ ID NO: 116 - RNA, 19 nt, Artificial Sequence
  Description of Artificial Sequence: Synthetic oligonucleotide
ucauuauccauuuuacaca

SEQ ID NO: 117 - RNA, 19 nt, Artificial Sequence
  Description of Artificial Sequence: Synthetic oligonucleotide
uaaccgggaugaugagugc

SEQ ID NO: 118 - RNA, 19 nt, Artificial Sequence
  Description of Artificial Sequence: Synthetic oligonucleotide
uuucuuugggccauuccug

SEQ ID NO: 119 - RNA, 19 nt, Artificial Sequence
  Description of Artificial Sequence: Synthetic oligonucleotide
ucuaaggguaucuuggcuu

SEQ ID NO: 120 - RNA, 19 nt, Artificial Sequence
  Description of Artificial Sequence: Synthetic oligonucleotide
uuuggugugagcauugcuu

SEQ ID NO: 121 - RNA, 19 nt, Artificial Sequence
  Description of Artificial Sequence: Synthetic oligonucleotide
ucauaugggucguugagaa

SEQ ID NO: 122 - RNA, 19 nt, Artificial Sequence
  Description of Artificial Sequence: Synthetic oligonucleotide
uuuaauguguauccagaga

SEQ ID NO: 123 - RNA, 19 nt, Artificial Sequence
  Description of Artificial Sequence: Synthetic oligonucleotide
uucagauguuuuaaggaga

SEQ ID NO: 124 - RNA, 19 nt, Artificial Sequence
  Description of Artificial Sequence: Synthetic oligonucleotide
uuuccaaugauggagccuc

SEQ ID NO: 125 - RNA, 19 nt, Artificial Sequence
  Description of Artificial Sequence: Synthetic oligonucleotide
uagaauccaguccacguac

SEQ ID NO: 126 - RNA, 19 nt, Artificial Sequence
  Description of Artificial Sequence: Synthetic oligonucleotide
uuuugagauucuuugggcc

SEQ ID NO: 127 - RNA, 19 nt, Artificial Sequence
  Description of Artificial Sequence: Synthetic oligonucleotide
uaaucauccugaaaagacc

SEQ ID NO: 128 - RNA, 19 nt, Artificial Sequence
  Description of Artificial Sequence: Synthetic oligonucleotide
uagacacgcaaaaucuuag

SEQ ID NO: 129 - RNA, 19 nt, Artificial Sequence
  Description of Artificial Sequence: Synthetic oligonucleotide
ucguacucgaccacguugg

SEQ ID NO: 130 - RNA, 19 nt, Artificial Sequence
  Description of Artificial Sequence: Synthetic oligonucleotide
ucauccagucacccagcaa

SEQ ID NO: 131 - RNA, 19 nt, Artificial Sequence
  Description of Artificial Sequence: Synthetic oligonucleotide
uaacacugggaugcugugc

SEQ ID NO: 132 - RNA, 19 nt, Artificial Sequence
  Description of Artificial Sequence: Synthetic oligonucleotide
ucagaaagagcuuugcucu

SEQ ID NO: 133 - RNA, 19 nt, Artificial Sequence
  Description of Artificial Sequence: Synthetic oligonucleotide
uuucuuugagauucuuugg

SEQ ID NO: 134 - RNA, 19 nt, Artificial Sequence
  Description of Artificial Sequence: Synthetic oligonucleotide
uagcaacaauauccaguuc

SEQ ID NO: 135 - RNA, 19 nt, Artificial Sequence
  Description of Artificial Sequence: Synthetic oligonucleotide
uaccacuuuaucgagcuuc

SEQ ID NO: 136 - RNA, 19 nt, Artificial Sequence
  Description of Artificial Sequence: Synthetic oligonucleotide
ucccuucccuucguugcag

SEQ ID NO: 137 - RNA, 19 nt, Artificial Sequence
  Description of Artificial Sequence: Synthetic oligonucleotide
ucgcaaaaucuuaggugac

SEQ ID NO: 138 - RNA, 19 nt, Artificial Sequence
  Description of Artificial Sequence: Synthetic oligonucleotide
uagcguguuacuguggagg

SEQ ID NO: 139 - RNA, 19 nt, Artificial Sequence
  Description of Artificial Sequence: Synthetic oligonucleotide
ucuccuucccuguagccgg

SEQ ID NO: 140 - RNA, 19 nt, Artificial Sequence
  Description of Artificial Sequence: Synthetic oligonucleotide
uguccucuguaucucuucu

SEQ ID NO: 141 - RNA, 19 nt, Artificial Sequence
  Description of Artificial Sequence: Synthetic oligonucleotide
uguaucuuggcuuucugga

SEQ ID NO: 142 - RNA, 19 nt, Artificial Sequence
  Description of Artificial Sequence: Synthetic oligonucleotide
ucucuuggcaguguuucug

SEQ ID NO: 143 - RNA, 19 nt, Artificial Sequence
  Description of Artificial Sequence: Synthetic oligonucleotide
ugaaaucagugucauggua

SEQ ID NO: 144 - RNA, 19 nt, Artificial Sequence
  Description of Artificial Sequence: Synthetic oligonucleotide
ucuucccuguagccggcac

SEQ ID NO: 145 - RNA, 19 nt, Artificial Sequence
  Description of Artificial Sequence: Synthetic oligonucleotide
ucuggccgcucccuuugag

SEQ ID NO: 146 - RNA, 19 nt, Artificial Sequence
  Description of Artificial Sequence: Synthetic oligonucleotide
ucacgcaaaaucuuaggug

SEQ ID NO: 147 - RNA, 19 nt, Artificial Sequence
  Description of Artificial Sequence: Synthetic oligonucleotide
ugaaaccagaaagagcuuu

SEQ ID NO: 148 - RNA, 19 nt, Artificial Sequence
  Description of Artificial Sequence: Synthetic oligonucleotide
uaaagcuuuaaguaacacu

SEQ ID NO: 149 - RNA, 19 nt, Artificial Sequence
  Description of Artificial Sequence: Synthetic oligonucleotide
uacaagccagauuagaaag

SEQ ID NO: 150 - RNA, 19 nt, Artificial Sequence
  Description of Artificial Sequence: Synthetic oligonucleotide
uacucauuauccauuuuac

SEQ ID NO: 151 - RNA, 19 nt, Artificial Sequence
  Description of Artificial Sequence: Synthetic oligonucleotide
uccugaaaagaccuuguug

SEQ ID NO: 152 - RNA, 19 nt, Artificial Sequence
  Description of Artificial Sequence: Synthetic oligonucleotide
ugguuuccaaugauggagc

SEQ ID NO: 153 - RNA, 19 nt, Artificial Sequence
  Description of Artificial Sequence: Synthetic oligonucleotide
ucaguuucuggcaggccuc

SEQ ID NO: 154 - RNA, 19 nt, Artificial Sequence
  Description of Artificial Sequence: Synthetic oligonucleotide
uauggcagaacacugggau

SEQ ID NO: 155 - RNA, 19 nt, Artificial Sequence
  Description of Artificial Sequence: Synthetic oligonucleotide
uagauuucuuugagauucu

SEQ ID NO: 156 - RNA, 19 nt, Artificial Sequence
  Description of Artificial Sequence: Synthetic oligonucleotide
uguuuccaguuucaacaag

SEQ ID NO: 157 - RNA, 19 nt, Artificial Sequence
  Description of Artificial Sequence: Synthetic oligonucleotide
uuccucuguaucucuucug

SEQ ID NO: 158 - RNA, 19 nt, Artificial Sequence
  Description of Artificial Sequence: Synthetic oligonucleotide
ucauccugaaaagaccuug

SEQ ID NO: 159 - RNA, 19 nt, Artificial Sequence
  Description of Artificial Sequence: Synthetic oligonucleotide
uuugaguuuucuccagaau

SEQ ID NO: 160 - RNA, 19 nt, Artificial Sequence
  Description of Artificial Sequence: Synthetic oligonucleotide
uaauucacugugguuucca

SEQ ID NO: 161 - RNA, 19 nt, Artificial Sequence
  Description of Artificial Sequence: Synthetic oligonucleotide
uaagauuucuuugagauuc

SEQ ID NO: 162 - RNA, 19 nt, Artificial Sequence
  Description of Artificial Sequence: Synthetic oligonucleotide
uggagacaaagauuucuuu

SEQ ID NO: 163 - RNA, 19 nt, Artificial Sequence
  Description of Artificial Sequence: Synthetic oligonucleotide
ugaaaaucauccugaaaag

SEQ ID NO: 164 - RNA, 19 nt, Artificial Sequence
  Description of Artificial Sequence: Synthetic oligonucleotide
ucuuucugccauuuuauac

SEQ ID NO: 165 - RNA, 19 nt, Artificial Sequence
  Description of Artificial Sequence: Synthetic oligonucleotide
uaguccacguacucgacca

SEQ ID NO: 166 - RNA, 19 nt, Artificial Sequence
  Description of Artificial Sequence: Synthetic oligonucleotide
uuuaaugcguguacugggc

SEQ ID NO: 167 - RNA, 19 nt, Artificial Sequence
  Description of Artificial Sequence: Synthetic oligonucleotide
uuaauguguauccagagau

SEQ ID NO: 168 - RNA, 19 nt, Artificial Sequence
  Description of Artificial Sequence: Synthetic oligonucleotide
ugauucuuugggccauucc

SEQ ID NO: 169 - RNA, 19 nt, Artificial Sequence
  Description of Artificial Sequence: Synthetic oligonucleotide
uugaaaccagaaagagcuu

SEQ ID NO: 170 - RNA, 19 nt, Artificial Sequence
  Description of Artificial Sequence: Synthetic oligonucleotide
ucacacauucaccagaaac

SEQ ID NO: 171 - RNA, 19 nt, Artificial Sequence
  Description of Artificial Sequence: Synthetic oligonucleotide
uacaaagauuucuuugaga

SEQ ID NO: 172 - RNA, 19 nt, Artificial Sequence
  Description of Artificial Sequence: Synthetic oligonucleotide
ucauuucuaucuccuuugg

SEQ ID NO: 173 - RNA, 19 nt, Artificial Sequence
  Description of Artificial Sequence: Synthetic oligonucleotide
uuuucuguaacacugucuu

SEQ ID NO: 174 - RNA, 19 nt, Artificial Sequence
  Description of Artificial Sequence: Synthetic oligonucleotide
uggauuucagugaaaaucc

SEQ ID NO: 175 - RNA, 19 nt, Artificial Sequence
  Description of Artificial Sequence: Synthetic oligonucleotide
ucgcucccuuugagcacag

SEQ ID NO: 176 - RNA, 19 nt, Artificial Sequence
  Description of Artificial Sequence: Synthetic oligonucleotide
ucaguccacguacucgacc

SEQ ID NO: 177 - RNA, 19 nt, Artificial Sequence
  Description of Artificial Sequence: Synthetic oligonucleotide
uaggcauaugggucguuga

SEQ ID NO: 178 - RNA, 19 nt, Artificial Sequence
  Description of Artificial Sequence: Synthetic oligonucleotide
uauguccucuguaucucuu

SEQ ID NO: 179 - RNA, 19 nt, Artificial Sequence
  Description of Artificial Sequence: Synthetic oligonucleotide
ugcuugauuuuggugguac

SEQ ID NO: 180 - RNA, 19 nt, Artificial Sequence
  Description of Artificial Sequence: Synthetic oligonucleotide
uaugauggagccuccacac

SEQ ID NO: 181 - RNA, 19 nt, Artificial Sequence
  Description of Artificial Sequence: Synthetic oligonucleotide
uucguugagaaucugugua

SEQ ID NO: 182 - RNA, 19 nt, Artificial Sequence
  Description of Artificial Sequence: Synthetic oligonucleotide
uuuauccauuuuacacaac

SEQ ID NO: 183 - RNA, 19 nt, Artificial Sequence
  Description of Artificial Sequence: Synthetic oligonucleotide
uuguccuauucacucuugg

SEQ ID NO: 184 - RNA, 19 nt, Artificial Sequence
  Description of Artificial Sequence: Synthetic oligonucleotide
ucaauauccaguucuucuc

SEQ ID NO: 185 - RNA, 19 nt, Artificial Sequence
  Description of Artificial Sequence: Synthetic oligonucleotide
ucuuugagauucuuugggc

SEQ ID NO: 186 - RNA, 19 nt, Artificial Sequence
  Description of Artificial Sequence: Synthetic oligonucleotide
ucacucuuggcaguguuuc

SEQ ID NO: 187 - RNA, 19 nt, Artificial Sequence
  Description of Artificial Sequence: Synthetic oligonucleotide
ucuugaaagaauacccaga

SEQ ID NO: 188 - RNA, 19 nt, Artificial Sequence
  Description of Artificial Sequence: Synthetic oligonucleotide
uaggcaauaucauacccgc

SEQ ID NO: 189 - RNA, 19 nt, Artificial Sequence
  Description of Artificial Sequence: Synthetic oligonucleotide
ucuguguaauucacugugg

SEQ ID NO: 190 - RNA, 19 nt, Artificial Sequence
  Description of Artificial Sequence: Synthetic oligonucleotide
uaauauccacugguuucca

SEQ ID NO: 191 - RNA, 19 nt, Artificial Sequence
  Description of Artificial Sequence: Synthetic oligonucleotide
uugaaagaauacccagaaa

SEQ ID NO: 192 - RNA, 19 nt, Artificial Sequence
  Description of Artificial Sequence: Synthetic oligonucleotide
uguuaauauccacugguuu

SEQ ID NO: 193 - RNA, 19 nt, Artificial Sequence
  Description of Artificial Sequence: Synthetic oligonucleotide
uugucaugguaaaaugaag

SEQ ID NO: 194 - RNA, 19 nt, Artificial Sequence
  Description of Artificial Sequence: Synthetic oligonucleotide
uauucuuugggccauuccu

SEQ ID NO: 195 - RNA, 19 nt, Artificial Sequence
  Description of Artificial Sequence: Synthetic oligonucleotide
ucaguuccuccaacgaucc

SEQ ID NO: 196 - RNA, 19 nt, Artificial Sequence
  Description of Artificial Sequence: Synthetic oligonucleotide
ugggugugcuucaguagac

SEQ ID NO: 197 - RNA, 19 nt, Artificial Sequence
  Description of Artificial Sequence: Synthetic oligonucleotide
ugaagaaagcuuuaaguaa

SEQ ID NO: 198 - RNA, 19 nt, Artificial Sequence
  Description of Artificial Sequence: Synthetic oligonucleotide
uauccugaaaagaccuugu

SEQ ID NO: 199 - RNA, 19 nt, Artificial Sequence
  Description of Artificial Sequence: Synthetic oligonucleotide
uagaaagcuuuaaguaaca

SEQ ID NO: 200 - RNA, 19 nt, Artificial Sequence
  Description of Artificial Sequence: Synthetic oligonucleotide
ucaguguuucuguaacacu

SEQ ID NO: 201 - RNA, 19 nt, Artificial Sequence
  Description of Artificial Sequence: Synthetic oligonucleotide
ugacacgcaaaaucuuagg

SEQ ID NO: 202 - RNA, 19 nt, Artificial Sequence
  Description of Artificial Sequence: Synthetic oligonucleotide
ugugugagcauugcuugaa

SEQ ID NO: 203 - RNA, 19 nt, Artificial Sequence
  Description of Artificial Sequence: Synthetic oligonucleotide
uaccagaaagagcuuugcu

SEQ ID NO: 204 - RNA, 19 nt, Artificial Sequence
  Description of Artificial Sequence: Synthetic oligonucleotide
uagaaagugcacaggauuu

SEQ ID NO: 205 - RNA, 19 nt, Artificial Sequence
  Description of Artificial Sequence: Synthetic oligonucleotide
uuuuauuucagauugauuu

SEQ ID NO: 206 - RNA, 19 nt, Artificial Sequence
  Description of Artificial Sequence: Synthetic oligonucleotide
uuauccaguucuucuccca

SEQ ID NO: 207 - RNA, 19 nt, Artificial Sequence
  Description of Artificial Sequence: Synthetic oligonucleotide
uccgugaaagugaagagua

SEQ ID NO: 208 - RNA, 19 nt, Artificial Sequence
  Description of Artificial Sequence: Synthetic oligonucleotide
uggugugcuucaguagaca

SEQ ID NO: 209 - RNA, 19 nt, Artificial Sequence
  Description of Artificial Sequence: Synthetic oligonucleotide
uggacagagggccucccga

SEQ ID NO: 210 - RNA, 19 nt, Artificial Sequence
  Description of Artificial Sequence: Synthetic oligonucleotide
uaagaaaaucauccugaaa

SEQ ID NO: 211 - RNA, 19 nt, Artificial Sequence
  Description of Artificial Sequence: Synthetic oligonucleotide
uugagauucuuugggccau

SEQ ID NO: 212 - RNA, 19 nt, Artificial Sequence
  Description of Artificial Sequence: Synthetic oligonucleotide
uauguuuuaaggagacaaa

SEQ ID NO: 213 - RNA, 19 nt, Artificial Sequence
  Description of Artificial Sequence: Synthetic oligonucleotide
ucacaguuucuggcaggcc

SEQ ID NO: 214 - RNA, 19 nt, Artificial Sequence
  Description of Artificial Sequence: Synthetic oligonucleotide
uacaauauccaguucuucu

SEQ ID NO: 215 - RNA, 19 nt, Artificial Sequence
  Description of Artificial Sequence: Synthetic oligonucleotide
uacauucaccagaaacuga

SEQ ID NO: 216 - RNA, 19 nt, Artificial Sequence
  Description of Artificial Sequence: Synthetic oligonucleotide
ucaaggcaauaucauaccc

SEQ ID NO: 217 - RNA, 19 nt, Artificial Sequence
  Description of Artificial Sequence: Synthetic oligonucleotide
ucuccaacgauccugggcu

SEQ ID NO: 218 - RNA, 19 nt, Artificial Sequence
  Description of Artificial Sequence: Synthetic oligonucleotide
ucugaaaccagaaagagcu

SEQ ID NO: 219 - RNA, 19 nt, Artificial Sequence
  Description of Artificial Sequence: Synthetic oligonucleotide
uaaucucccuugcaagcgu

SEQ ID NO: 220 - RNA, 19 nt, Artificial Sequence
  Description of Artificial Sequence: Synthetic oligonucleotide
uuguguaauucacuguggu

SEQ ID NO: 221 - RNA, 19 nt, Artificial Sequence
  Description of Artificial Sequence: Synthetic oligonucleotide
uuuucagugaaaauccaga

SEQ ID NO: 222 - RNA, 19 nt, Artificial Sequence
  Description of Artificial Sequence: Synthetic oligonucleotide
uaaaucauccugaaaagac

SEQ ID NO: 223 - RNA, 19 nt, Artificial Sequence
  Description of Artificial Sequence: Synthetic oligonucleotide
uuacacucauuauccauuu

SEQ ID NO: 224 - RNA, 19 nt, Artificial Sequence
  Description of Artificial Sequence: Synthetic oligonucleotide
uuuggcaguguuucuguaa

SEQ ID NO: 225 - RNA, 19 nt, Artificial Sequence
  Description of Artificial Sequence: Synthetic oligonucleotide
ugguacacucauuauccau

SEQ ID NO: 226 - RNA, 19 nt, Artificial Sequence
  Description of Artificial Sequence: Synthetic oligonucleotide
uaggcaggcauaugggucg

SEQ ID NO: 227 - RNA, 19 nt, Artificial Sequence
  Description of Artificial Sequence: Synthetic oligonucleotide
uccaguuucaacaaggcaa

SEQ ID NO: 228 - RNA, 19 nt, Artificial Sequence
  Description of Artificial Sequence: Synthetic oligonucleotide
uuggccgcucccuuugagc

SEQ ID NO: 229 - RNA, 19 nt, Artificial Sequence
  Description of Artificial Sequence: Synthetic oligonucleotide
uacugugguuuccaguuuc

SEQ ID NO: 230 - RNA, 19 nt, Artificial Sequence
  Description of Artificial Sequence: Synthetic oligonucleotide
ucuuugggccauuccuggg

SEQ ID NO: 231 - RNA, 19 nt, Artificial Sequence
  Description of Artificial Sequence: Synthetic oligonucleotide
uuaagaaaaucauccugaa

SEQ ID NO: 232 - RNA, 19 nt, Artificial Sequence
  Description of Artificial Sequence: Synthetic oligonucleotide
ucucuuuuauuucagauug

SEQ ID NO: 233 - RNA, 19 nt, Artificial Sequence
  Description of Artificial Sequence: Synthetic oligonucleotide
uucuuugagauucuuuggg

SEQ ID NO: 234 - RNA, 19 nt, Artificial Sequence
  Description of Artificial Sequence: Synthetic oligonucleotide
uaaugauggagccuccaca

SEQ ID NO: 235 - RNA, 19 nt, Artificial Sequence
  Description of Artificial Sequence: Synthetic oligonucleotide
ugaagaauggcagaacacu

SEQ ID NO: 236 - RNA, 19 nt, Artificial Sequence
  Description of Artificial Sequence: Synthetic oligonucleotide
ucaaugauggagccuccac

SEQ ID NO: 237 - RNA, 19 nt, Artificial Sequence
  Description of Artificial Sequence: Synthetic oligonucleotide
uauggagccuccacacagg

SEQ ID NO: 238 - RNA, 19 nt, Artificial Sequence
  Description of Artificial Sequence: Synthetic oligonucleotide
ucccaagaaaucaguguca

SEQ ID NO: 239 - RNA, 19 nt, Artificial Sequence
  Description of Artificial Sequence: Synthetic oligonucleotide
ugagccuccacacaggugu

SEQ ID NO: 240 - RNA, 19 nt, Artificial Sequence
  Description of Artificial Sequence: Synthetic oligonucleotide
ucucccaagaaaucagugu

SEQ ID NO: 241 - RNA, 19 nt, Artificial Sequence
  Description of Artificial Sequence: Synthetic oligonucleotide
uccuccacacaggugucuc

SEQ ID NO: 242 - RNA, 19 nt, Artificial Sequence
  Description of Artificial Sequence: Synthetic oligonucleotide
uccaaugauggagccucca

SEQ ID NO: 243 - RNA, 19 nt, Artificial Sequence
  Description of Artificial Sequence: Synthetic oligonucleotide
uuuuccaaugauggagccu

SEQ ID NO: 244 - RNA, 19 nt, Artificial Sequence
  Description of Artificial Sequence: Synthetic oligonucleotide
uucccaagaaaucaguguc

SEQ ID NO: 245 - RNA, 19 nt, Artificial Sequence
  Description of Artificial Sequence: Synthetic oligonucleotide
uagccuccacacagguguc

SEQ ID NO: 246 - RNA, 19 nt, Artificial Sequence
  Description of Artificial Sequence: Synthetic oligonucleotide
uucuucucccaagaaauca

SEQ ID NO: 247 - RNA, 19 nt, Artificial Sequence
  Description of Artificial Sequence: Synthetic oligonucleotide
uguuuccaaugauggagcc

SEQ ID NO: 248 - RNA, 19 nt, Artificial Sequence
  Description of Artificial Sequence: Synthetic oligonucleotide
uuccaaugauggagccucc

SEQ ID NO: 249 - RNA, 19 nt, Artificial Sequence
  Description of Artificial Sequence: Synthetic oligonucleotide
uuggagccuccacacaggu

SEQ ID NO: 250 - RNA, 19 nt, Artificial Sequence
  Description of Artificial Sequence: Synthetic oligonucleotide
ugccuccacacaggugucu

SEQ ID NO: 251 - RNA, 15 nt, Artificial Sequence
  Description of Artificial Sequence: Synthetic oligonucleotide
caccuaagauuuuga

SEQ ID NO: 252 - RNA, 15 nt, Artificial Sequence
  Description of Artificial Sequence: Synthetic oligonucleotide
cauuuuaaaucaaua

SEQ ID NO: 253 - RNA, 15 nt, Artificial Sequence
  Description of Artificial Sequence: Synthetic oligonucleotide
cagcagcgauuucua

SEQ ID NO: 254 - RNA, 15 nt, Artificial Sequence
  Description of Artificial Sequence: Synthetic oligonucleotide
gaugauuuucuuaua

SEQ ID NO: 255 - RNA, 15 nt, Artificial Sequence
  Description of Artificial Sequence: Synthetic oligonucleotide
cuaauacgguguuua

SEQ ID NO: 256 - RNA, 15 nt, Artificial Sequence
  Description of Artificial Sequence: Synthetic oligonucleotide
caugacacugauuua

SEQ ID NO: 257 - RNA, 15 nt, Artificial Sequence
  Description of Artificial Sequence: Synthetic oligonucleotide
cagaaagcggguaua

SEQ ID NO: 258 - RNA, 15 nt, Artificial Sequence
  Description of Artificial Sequence: Synthetic oligonucleotide
uccuuaaaacaucua

SEQ ID NO: 259 - RNA, 15 nt, Artificial Sequence
  Description of Artificial Sequence: Synthetic oligonucleotide
aaagccaagauacca

SEQ ID NO: 260 - RNA, 15 nt, Artificial Sequence
  Description of Artificial Sequence: Synthetic oligonucleotide
gaagagauacagaga

SEQ ID NO: 261 - RNA, 15 nt, Artificial Sequence
  Description of Artificial Sequence: Synthetic oligonucleotide
aaauaauaauccaua

SEQ ID NO: 262 - RNA, 15 nt, Artificial Sequence
  Description of Artificial Sequence: Synthetic oligonucleotide
uuucuaaucuggcua

SEQ ID NO: 263 - RNA, 15 nt, Artificial Sequence
  Description of Artificial Sequence: Synthetic oligonucleotide
caaugccguccgcua

SEQ ID NO: 264 - RNA, 15 nt, Artificial Sequence
  Description of Artificial Sequence: Synthetic oligonucleotide
aaucaaucugaaaua

SEQ ID NO: 265 - RNA, 15 nt, Artificial Sequence
  Description of Artificial Sequence: Synthetic oligonucleotide
aaacuaagagacaaa

SEQ ID NO: 266 - RNA, 15 nt, Artificial Sequence
  Description of Artificial Sequence: Synthetic oligonucleotide
caucccaguguucua

SEQ ID NO: 267 - RNA, 15 nt, Artificial Sequence
  Description of Artificial Sequence: Synthetic oligonucleotide
cuuauaucaagugga

SEQ ID NO: 268 - RNA, 15 nt, Artificial Sequence
  Description of Artificial Sequence: Synthetic oligonucleotide
uuuguaagaaaauga

SEQ ID NO: 269 - RNA, 15 nt, Artificial Sequence
  Description of Artificial Sequence: Synthetic oligonucleotide
caguacacgcauuaa

SEQ ID NO: 270 - RNA, 15 nt, Artificial Sequence
  Description of Artificial Sequence: Synthetic oligonucleotide
aggcccucuguccua

SEQ ID NO: 271 - RNA, 15 nt, Artificial Sequence
  Description of Artificial Sequence: Synthetic oligonucleotide
caucaucccgguuga

SEQ ID NO: 272 - RNA, 15 nt, Artificial Sequence
  Description of Artificial Sequence: Synthetic oligonucleotide
aagaaaucuuuguca

SEQ ID NO: 273 - RNA, 15 nt, Artificial Sequence
  Description of Artificial Sequence: Synthetic oligonucleotide
cagcaugcuuccuca

SEQ ID NO: 274 - RNA, 15 nt, Artificial Sequence
  Description of Artificial Sequence: Synthetic oligonucleotide
uagggacauuuucca

SEQ ID NO: 275 - RNA, 15 nt, Artificial Sequence
  Description of Artificial Sequence: Synthetic oligonucleotide
caaguguuacuuaaa

SEQ ID NO: 276 - RNA, 15 nt, Artificial Sequence
  Description of Artificial Sequence: Synthetic oligonucleotide
cggguaugauauuga

SEQ ID NO: 277 - RNA, 15 nt, Artificial Sequence
  Description of Artificial Sequence: Synthetic oligonucleotide
caagugguacauuua

SEQ ID NO: 278 - RNA, 15 nt, Artificial Sequence
  Description of Artificial Sequence: Synthetic oligonucleotide
caggaugauuuucua

SEQ ID NO: 279 - RNA, 15 nt, Artificial Sequence
  Description of Artificial Sequence: Synthetic oligonucleotide
aagggcaaguguuaa

SEQ ID NO: 280 - RNA, 15 nt, Artificial Sequence
  Description of Artificial Sequence: Synthetic oligonucleotide
uguaagaaaaugcua

SEQ ID NO: 281 - RNA, 15 nt, Artificial Sequence
  Description of Artificial Sequence: Synthetic oligonucleotide
uaauacgguguuuga

SEQ ID NO: 282 - RNA, 15 nt, Artificial Sequence
  Description of Artificial Sequence: Synthetic oligonucleotide
uauuaacagccgcua

SEQ ID NO: 283 - RNA, 15 nt, Artificial Sequence
  Description of Artificial Sequence: Synthetic oligonucleotide
auuaacagccgcuca

SEQ ID NO: 284 - RNA, 15 nt, Artificial Sequence
  Description of Artificial Sequence: Synthetic oligonucleotide
gaaaucuuugucuca

SEQ ID NO: 285 - RNA, 15 nt, Artificial Sequence
  Description of Artificial Sequence: Synthetic oligonucleotide
cauaaaauaacccaa

SEQ ID NO: 286 - RNA, 15 nt, Artificial Sequence
  Description of Artificial Sequence: Synthetic oligonucleotide
cagugucauggcuca

SEQ ID NO: 287 - RNA, 15 nt, Artificial Sequence
  Description of Artificial Sequence: Synthetic oligonucleotide
cacuuucuaaucuga

SEQ ID NO: 288 - RNA, 15 nt, Artificial Sequence
  Description of Artificial Sequence: Synthetic oligonucleotide
uuucuggguauucua

SEQ ID NO: 289 - RNA, 15 nt, Artificial Sequence
  Description of Artificial Sequence: Synthetic oligonucleotide
ccuuaaaacaucuga

SEQ ID NO: 290 - RNA, 15 nt, Artificial Sequence
  Description of Artificial Sequence: Synthetic oligonucleotide
caucucuggauacaa

SEQ ID NO: 291 - RNA, 15 nt, Artificial Sequence
  Description of Artificial Sequence: Synthetic oligonucleotide
ugaaugugugacuca

SEQ ID NO: 292 - RNA, 15 nt, Artificial Sequence
  Description of Artificial Sequence: Synthetic oligonucleotide
cacaucuuucuuuga

SEQ ID NO: 293 - RNA, 15 nt, Artificial Sequence
  Description of Artificial Sequence: Synthetic oligonucleotide
uuauaucaaguggua

SEQ ID NO: 294 - RNA, 15 nt, Artificial Sequence
  Description of Artificial Sequence: Synthetic oligonucleotide
cuuaaagcuuucuua

SEQ ID NO: 295 - RNA, 15 nt, Artificial Sequence
  Description of Artificial Sequence: Synthetic oligonucleotide
ucaaucugaaauaaa

SEQ ID NO: 296 - RNA, 15 nt, Artificial Sequence
  Description of Artificial Sequence: Synthetic oligonucleotide
caaugcucacaccaa

SEQ ID NO: 297 - RNA, 15 nt, Artificial Sequence
  Description of Artificial Sequence: Synthetic oligonucleotide
cuuuucaggaugaua

SEQ ID NO: 298 - RNA, 15 nt, Artificial Sequence
  Description of Artificial Sequence: Synthetic oligonucleotide
caagcaaugcucaca

SEQ ID NO: 299 - RNA, 15 nt, Artificial Sequence
  Description of Artificial Sequence: Synthetic oligonucleotide
cagaagagauacaga

SEQ ID NO: 300 - RNA, 15 nt, Artificial Sequence
  Description of Artificial Sequence: Synthetic oligonucleotide
auacacauuaaggua

SEQ ID NO: 301 - RNA, 15 nt, Artificial Sequence
  Description of Artificial Sequence: Synthetic oligonucleotide
uaauaauccaugaua

SEQ ID NO: 302 - RNA, 15 nt, Artificial Sequence
  Description of Artificial Sequence: Synthetic oligonucleotide
caaagaaaucuuuga

SEQ ID NO: 303 - RNA, 15 nt, Artificial Sequence
  Description of Artificial Sequence: Synthetic oligonucleotide
aacuaaaauacuuca

SEQ ID NO: 304 - RNA, 15 nt, Artificial Sequence
  Description of Artificial Sequence: Synthetic oligonucleotide
uuuuaaaucaaucua

SEQ ID NO: 305 - RNA, 15 nt, Artificial Sequence
  Description of Artificial Sequence: Synthetic oligonucleotide
aagccaagauaccca

SEQ ID NO: 306 - RNA, 15 nt, Artificial Sequence
  Description of Artificial Sequence: Synthetic oligonucleotide
aaucuuugucuccua

SEQ ID NO: 307 - RNA, 15 nt, Artificial Sequence
  Description of Artificial Sequence: Synthetic oligonucleotide
cauuuuaccaugaca

SEQ ID NO: 308 - RNA, 15 nt, Artificial Sequence
  Description of Artificial Sequence: Synthetic oligonucleotide
gaagaacuggauaua

SEQ ID NO: 309 - RNA, 15 nt, Artificial Sequence
  Description of Artificial Sequence: Synthetic oligonucleotide
aagaacuggauauua

SEQ ID NO: 310 - RNA, 15 nt, Artificial Sequence
  Description of Artificial Sequence: Synthetic oligonucleotide
acuggaaaccacaga

SEQ ID NO: 311 - RNA, 15 nt, Artificial Sequence
  Description of Artificial Sequence: Synthetic oligonucleotide
gcacuuucuaaucua

SEQ ID NO: 312 - RNA, 15 nt, Artificial Sequence
  Description of Artificial Sequence: Synthetic oligonucleotide
ugacacugauuucua

SEQ ID NO: 313 - RNA, 15 nt, Artificial Sequence
  Description of Artificial Sequence: Synthetic oligonucleotide
gaaauaauaauccaa

SEQ ID NO: 314 - RNA, 15 nt, Artificial Sequence
  Description of Artificial Sequence: Synthetic oligonucleotide
acuuucuaaucugga

SEQ ID NO: 315 - RNA, 15 nt, Artificial Sequence
  Description of Artificial Sequence: Synthetic oligonucleotide
aaauggauaaugaga

SEQ ID NO: 316 - RNA, 15 nt, Artificial Sequence
  Description of Artificial Sequence: Synthetic oligonucleotide
caggaauggcccaaa

SEQ ID NO: 317 - RNA, 15 nt, Artificial Sequence
  Description of Artificial Sequence: Synthetic oligonucleotide
caaaaucaagcccaa

SEQ ID NO: 318 - RNA, 15 nt, Artificial Sequence
  Description of Artificial Sequence: Synthetic oligonucleotide
uuuaaaucaaucuga

SEQ ID NO: 319 - RNA, 15 nt, Artificial Sequence
  Description of Artificial Sequence: Synthetic oligonucleotide
caucccgguugcuua

SEQ ID NO: 320 - RNA, 15 nt, Artificial Sequence
  Description of Artificial Sequence: Synthetic oligonucleotide
ggauacacauuaaga

SEQ ID NO: 321 - RNA, 15 nt, Artificial Sequence
  Description of Artificial Sequence: Synthetic oligonucleotide
ccacagugaauuaca

SEQ ID NO: 322 - RNA, 15 nt, Artificial Sequence
  Description of Artificial Sequence: Synthetic oligonucleotide
ggagauagaaaugua

SEQ ID NO: 323 - RNA, 15 nt, Artificial Sequence
  Description of Artificial Sequence: Synthetic oligonucleotide
auuggaaaccaguga

SEQ ID NO: 324 - RNA, 15 nt, Artificial Sequence
  Description of Artificial Sequence: Synthetic oligonucleotide
aauuacacagauuca

SEQ ID NO: 325 - RNA, 15 nt, Artificial Sequence
  Description of Artificial Sequence: Synthetic oligonucleotide
agagugaauaggaca

SEQ ID NO: 326 - RNA, 15 nt, Artificial Sequence
  Description of Artificial Sequence: Synthetic oligonucleotide
uuucaagcaaugcua

SEQ ID NO: 327 - RNA, 15 nt, Artificial Sequence
  Description of Artificial Sequence: Synthetic oligonucleotide
gauuucuggguauua

SEQ ID NO: 328 - RNA, 15 nt, Artificial Sequence
  Description of Artificial Sequence: Synthetic oligonucleotide
caagaaauaauaaua

SEQ ID NO: 329 - RNA, 15 nt, Artificial Sequence
  Description of Artificial Sequence: Synthetic oligonucleotide
caacuaaaauacuua

SEQ ID NO: 330 - RNA, 15 nt, Artificial Sequence
  Description of Artificial Sequence: Synthetic oligonucleotide
cguggacuggauuca

SEQ ID NO: 331 - RNA, 15 nt, Artificial Sequence
  Description of Artificial Sequence: Synthetic oligonucleotide
agaaaucuuugucua

SEQ ID NO: 332 - RNA, 15 nt, Artificial Sequence
  Description of Artificial Sequence: Synthetic oligonucleotide
cacugaaauccugua

SEQ ID NO: 333 - RNA, 15 nt, Artificial Sequence
  Description of Artificial Sequence: Synthetic oligonucleotide
gauauugccuuguua

SEQ ID NO: 334 - RNA, 15 nt, Artificial Sequence
  Description of Artificial Sequence: Synthetic oligonucleotide
uaugauauugccuua

SEQ ID NO: 335 - RNA, 15 nt, Artificial Sequence
  Description of Artificial Sequence: Synthetic oligonucleotide
cgauuucuggguaua

SEQ ID NO: 336 - RNA, 15 nt, Artificial Sequence
  Description of Artificial Sequence: Synthetic oligonucleotide
auuuuaaaucaauca

SEQ ID NO: 337 - RNA, 15 nt, Artificial Sequence
  Description of Artificial Sequence: Synthetic oligonucleotide
caagagugaauagga

SEQ ID NO: 338 - RNA, 15 nt, Artificial Sequence
  Description of Artificial Sequence: Synthetic oligonucleotide
uuuugcgugucuaca

SEQ ID NO: 339 - RNA, 15 nt, Artificial Sequence
  Description of Artificial Sequence: Synthetic oligonucleotide
cuggagaaaacucaa

SEQ ID NO: 340 - RNA, 15 nt, Artificial Sequence
  Description of Artificial Sequence: Synthetic oligonucleotide
aaucucaaagaaaua

SEQ ID NO: 341 - RNA, 15 nt, Artificial Sequence
  Description of Artificial Sequence: Synthetic oligonucleotide
augauuuucuuauaa

SEQ ID NO: 342 - RNA, 15 nt, Artificial Sequence
  Description of Artificial Sequence: Synthetic oligonucleotide
ucaccuaagauuuua

SEQ ID NO: 343 - RNA, 15 nt, Artificial Sequence
  Description of Artificial Sequence: Synthetic oligonucleotide
cagcaucccagugua

SEQ ID NO: 344 - RNA, 15 nt, Artificial Sequence
  Description of Artificial Sequence: Synthetic oligonucleotide
ugaaauccugugcaa

SEQ ID NO: 345 - RNA, 15 nt, Artificial Sequence
  Description of Artificial Sequence: Synthetic oligonucleotide
aaucuggcuuguaua

SEQ ID NO: 346 - RNA, 15 nt, Artificial Sequence
  Description of Artificial Sequence: Synthetic oligonucleotide
aacuggaaaccacaa

SEQ ID NO: 347 - RNA, 15 nt, Artificial Sequence
  Description of Artificial Sequence: Synthetic oligonucleotide
cgaagggaagggcaa

SEQ ID NO: 348 - RNA, 15 nt, Artificial Sequence
  Description of Artificial Sequence: Synthetic oligonucleotide
uucaggaugauuuua

SEQ ID NO: 349 - RNA, 15 nt, Artificial Sequence
  Description of Artificial Sequence: Synthetic oligonucleotide
cacugauuucuugga

SEQ ID NO: 350 - RNA, 15 nt, Artificial Sequence
  Description of Artificial Sequence: Synthetic oligonucleotide
acgacccauaugcca

SEQ ID NO: 351 - RNA, 15 nt, Artificial Sequence
  Description of Artificial Sequence: Synthetic oligonucleotide
auuacacagauucua

SEQ ID NO: 352 - RNA, 15 nt, Artificial Sequence
  Description of Artificial Sequence: Synthetic oligonucleotide
uacguggacuggaua

SEQ ID NO: 353 - RNA, 15 nt, Artificial Sequence
  Description of Artificial Sequence: Synthetic oligonucleotide
aagagauacagagga

SEQ ID NO: 354 - RNA, 15 nt, Artificial Sequence
  Description of Artificial Sequence: Synthetic oligonucleotide
cugaaauccugugca

SEQ ID NO: 355 - RNA, 15 nt, Artificial Sequence
  Description of Artificial Sequence: Synthetic oligonucleotide
auucuucauuuuaca

SEQ ID NO: 356 - RNA, 15 nt, Artificial Sequence
  Description of Artificial Sequence: Synthetic oligonucleotide
agauucucaacgaca

SEQ ID NO: 357 - RNA, 15 nt, Artificial Sequence
  Description of Artificial Sequence: Synthetic oligonucleotide
cuggauauuguugca

SEQ ID NO: 358 - RNA, 15 nt, Artificial Sequence
  Description of Artificial Sequence: Synthetic oligonucleotide
aaugccguccgcuga

SEQ ID NO: 359 - RNA, 15 nt, Artificial Sequence
  Description of Artificial Sequence: Synthetic oligonucleotide
uacuuaaagcuuuca

SEQ ID NO: 360 - RNA, 15 nt, Artificial Sequence
  Description of Artificial Sequence: Synthetic oligonucleotide
uacagaaacacugca

SEQ ID NO: 361 - RNA, 15 nt, Artificial Sequence
  Description of Artificial Sequence: Synthetic oligonucleotide
uuacacagauucuca

SEQ ID NO: 362 - RNA, 15 nt, Artificial Sequence
  Description of Artificial Sequence: Synthetic oligonucleotide
guacguggacuggaa

SEQ ID NO: 363 - RNA, 15 nt, Artificial Sequence
  Description of Artificial Sequence: Synthetic oligonucleotide
aagcaaugcucacaa

SEQ ID NO: 364 - RNA, 15 nt, Artificial Sequence
  Description of Artificial Sequence: Synthetic oligonucleotide
acucaucaucccgga

SEQ ID NO: 365 - RNA, 15 nt, Artificial Sequence
  Description of Artificial Sequence: Synthetic oligonucleotide
gcucgauaaagugga

SEQ ID NO: 366 - RNA, 15 nt, Artificial Sequence
  Description of Artificial Sequence: Synthetic oligonucleotide
uaaaauggauaauga

SEQ ID NO: 367 - RNA, 15 nt, Artificial Sequence
  Description of Artificial Sequence: Synthetic oligonucleotide
ucaucaucccgguua

SEQ ID NO: 368 - RNA, 15 nt, Artificial Sequence
  Description of Artificial Sequence: Synthetic oligonucleotide
aauggcccaaagaaa

SEQ ID NO: 369 - RNA, 15 nt, Artificial Sequence
  Description of Artificial Sequence: Synthetic oligonucleotide
caagauacccuuaga

SEQ ID NO: 370 - RNA, 15 nt, Artificial Sequence
  Description of Artificial Sequence: Synthetic oligonucleotide
aaugcucacaccaaa

SEQ ID NO: 371 - RNA, 15 nt, Artificial Sequence
  Description of Artificial Sequence: Synthetic oligonucleotide
caacgacccauauga

SEQ ID NO: 372 - RNA, 15 nt, Artificial Sequence
  Description of Artificial Sequence: Synthetic oligonucleotide
uggauacacauuaaa

SEQ ID NO: 373 - RNA, 15 nt, Artificial Sequence
  Description of Artificial Sequence: Synthetic oligonucleotide
cuuaaaacaucugaa

SEQ ID NO: 374 - RNA, 15 nt, Artificial Sequence
  Description of Artificial Sequence: Synthetic oligonucleotide
cuccaucauuggaaa

SEQ ID NO: 375 - RNA, 15 nt, Artificial Sequence
  Description of Artificial Sequence: Synthetic oligonucleotide
guggacuggauucua

SEQ ID NO: 376 - RNA, 15 nt, Artificial Sequence
  Description of Artificial Sequence: Synthetic oligonucleotide
caaagaaucucaaaa

SEQ ID NO: 377 - RNA, 15 nt, Artificial Sequence
  Description of Artificial Sequence: Synthetic oligonucleotide
uuuucaggaugauua

SEQ ID NO: 378 - RNA, 15 nt, Artificial Sequence
  Description of Artificial Sequence: Synthetic oligonucleotide
gauuuugcgugucua

SEQ ID NO: 379 - RNA, 15 nt, Artificial Sequence
  Description of Artificial Sequence: Synthetic oligonucleotide
cguggucgaguacga

SEQ ID NO: 380 - RNA, 15 nt, Artificial Sequence
  Description of Artificial Sequence: Synthetic oligonucleotide
ugggugacuggauga

SEQ ID NO: 381 - RNA, 15 nt, Artificial Sequence
  Description of Artificial Sequence: Synthetic oligonucleotide
agcaucccaguguua

SEQ ID NO: 382 - RNA, 15 nt, Artificial Sequence
  Description of Artificial Sequence: Synthetic oligonucleotide
caaagcucuuucuga

SEQ ID NO: 383 - RNA, 15 nt, Artificial Sequence
  Description of Artificial Sequence: Synthetic oligonucleotide
agaaucucaaagaaa

SEQ ID NO: 384 - RNA, 15 nt, Artificial Sequence
  Description of Artificial Sequence: Synthetic oligonucleotide
uggauauuguugcua

SEQ ID NO: 385 - RNA, 15 nt, Artificial Sequence
  Description of Artificial Sequence: Synthetic oligonucleotide
cucgauaaaguggua

SEQ ID NO: 386 - RNA, 15 nt, Artificial Sequence
  Description of Artificial Sequence: Synthetic oligonucleotide
aacgaagggaaggga

SEQ ID NO: 387 - RNA, 15 nt, Artificial Sequence
  Description of Artificial Sequence: Synthetic oligonucleotide
ccuaagauuuugcga

SEQ ID NO: 388 - RNA, 15 nt, Artificial Sequence
  Description of Artificial Sequence: Synthetic oligonucleotide
cacaguaacacgcua

SEQ ID NO: 389 - RNA, 15 nt, Artificial Sequence
  Description of Artificial Sequence: Synthetic oligonucleotide
cuacagggaaggaga

SEQ ID NO: 390 - RNA, 15 nt, Artificial Sequence
  Description of Artificial Sequence: Synthetic oligonucleotide
gagauacagaggaca

SEQ ID NO: 391 - RNA, 15 nt, Artificial Sequence
  Description of Artificial Sequence: Synthetic oligonucleotide
gaaagccaagauaca

SEQ ID NO: 392 - RNA, 15 nt, Artificial Sequence
  Description of Artificial Sequence: Synthetic oligonucleotide
aacacugccaagaga

SEQ ID NO: 393 - RNA, 15 nt, Artificial Sequence
  Description of Artificial Sequence: Synthetic oligonucleotide
augacacugauuuca

SEQ ID NO: 394 - RNA, 15 nt, Artificial Sequence
  Description of Artificial Sequence: Synthetic oligonucleotide
cggcuacagggaaga

SEQ ID NO: 395 - RNA, 15 nt, Artificial Sequence
  Description of Artificial Sequence: Synthetic oligonucleotide
aagggagcggccaga

SEQ ID NO: 396 - RNA, 15 nt, Artificial Sequence
  Description of Artificial Sequence: Synthetic oligonucleotide
uaagauuuugcguga

SEQ ID NO: 397 - RNA, 15 nt, Artificial Sequence
  Description of Artificial Sequence: Synthetic oligonucleotide
cucuuucugguuuca

SEQ ID NO: 398 - RNA, 15 nt, Artificial Sequence
  Description of Artificial Sequence: Synthetic oligonucleotide
uuacuuaaagcuuua

SEQ ID NO: 399 - RNA, 15 nt, Artificial Sequence
  Description of Artificial Sequence: Synthetic oligonucleotide
cuaaucuggcuugua

SEQ ID NO: 400 - RNA, 15 nt, Artificial Sequence
  Description of Artificial Sequence: Synthetic oligonucleotide
aauggauaaugagua

SEQ ID NO: 401 - RNA, 15 nt, Artificial Sequence
  Description of Artificial Sequence: Synthetic oligonucleotide
aaggucuuuucagga

SEQ ID NO: 402 - RNA, 15 nt, Artificial Sequence
  Description of Artificial Sequence: Synthetic oligonucleotide
caucauuggaaacca

SEQ ID NO: 403 - RNA, 15 nt, Artificial Sequence
  Description of Artificial Sequence: Synthetic oligonucleotide
ccugccagaaacuga

SEQ ID NO: 404 - RNA, 15 nt, Artificial Sequence
  Description of Artificial Sequence: Synthetic oligonucleotide
caguguucugccaua

SEQ ID NO: 405 - RNA, 15 nt, Artificial Sequence
  Description of Artificial Sequence: Synthetic oligonucleotide
ucucaaagaaaucua

SEQ ID NO: 406 - RNA, 15 nt, Artificial Sequence
  Description of Artificial Sequence: Synthetic oligonucleotide
uugaaacuggaaaca

SEQ ID NO: 407 - RNA, 15 nt, Artificial Sequence
  Description of Artificial Sequence: Synthetic oligonucleotide
agagauacagaggaa

SEQ ID NO: 408 - RNA, 15 nt, Artificial Sequence
  Description of Artificial Sequence: Synthetic oligonucleotide
gucuuuucaggauga

SEQ ID NO: 409 - RNA, 15 nt, Artificial Sequence
  Description of Artificial Sequence: Synthetic oligonucleotide
uggagaaaacucaaa

SEQ ID NO: 410 - RNA, 15 nt, Artificial Sequence
  Description of Artificial Sequence: Synthetic oligonucleotide
aaccacagugaauua

SEQ ID NO: 411 - RNA, 15 nt, Artificial Sequence
  Description of Artificial Sequence: Synthetic oligonucleotide
cucaaagaaaucuua

SEQ ID NO: 412 - RNA, 15 nt, Artificial Sequence
  Description of Artificial Sequence: Synthetic oligonucleotide
aaaucuuugucucca

SEQ ID NO: 413 - RNA, 15 nt, Artificial Sequence
  Description of Artificial Sequence: Synthetic oligonucleotide
ucaggaugauuuuca

SEQ ID NO: 414 - RNA, 15 nt, Artificial Sequence
  Description of Artificial Sequence: Synthetic oligonucleotide
aaaauggcagaaaga

SEQ ID NO: 415 - RNA, 15 nt, Artificial Sequence
  Description of Artificial Sequence: Synthetic oligonucleotide
cgaguacguggacua

SEQ ID NO: 416 - RNA, 15 nt, Artificial Sequence
  Description of Artificial Sequence: Synthetic oligonucleotide
aguacacgcauuaaa

SEQ ID NO: 417 - RNA, 15 nt, Artificial Sequence
  Description of Artificial Sequence: Synthetic oligonucleotide
cuggauacacauuaa

SEQ ID NO: 418 - RNA, 15 nt, Artificial Sequence
  Description of Artificial Sequence: Synthetic oligonucleotide
uggcccaaagaauca

SEQ ID NO: 419 - RNA, 15 nt, Artificial Sequence
  Description of Artificial Sequence: Synthetic oligonucleotide
ucuuucugguuucaa

SEQ ID NO: 420 - RNA, 15 nt, Artificial Sequence
  Description of Artificial Sequence: Synthetic oligonucleotide
cuggugaauguguga

SEQ ID NO: 421 - RNA, 15 nt, Artificial Sequence
  Description of Artificial Sequence: Synthetic oligonucleotide
aaagaaaucuuugua

SEQ ID NO: 422 - RNA, 15 nt, Artificial Sequence
  Description of Artificial Sequence: Synthetic oligonucleotide
aggagauagaaauga

SEQ ID NO: 423 - RNA, 15 nt, Artificial Sequence
  Description of Artificial Sequence: Synthetic oligonucleotide
caguguuacagaaaa

SEQ ID NO: 424 - RNA, 15 nt, Artificial Sequence
  Description of Artificial Sequence: Synthetic oligonucleotide
uuucacugaaaucca

SEQ ID NO: 425 - RNA, 15 nt, Artificial Sequence
  Description of Artificial Sequence: Synthetic oligonucleotide
gcucaaagggagcga

SEQ ID NO: 426 - RNA, 15 nt, Artificial Sequence
  Description of Artificial Sequence: Synthetic oligonucleotide
gaguacguggacuga

SEQ ID NO: 427 - RNA, 15 nt, Artificial Sequence
  Description of Artificial Sequence: Synthetic oligonucleotide
cgacccauaugccua

SEQ ID NO: 428 - RNA, 15 nt, Artificial Sequence
  Description of Artificial Sequence: Synthetic oligonucleotide
gauacagaggacaua

SEQ ID NO: 429 - RNA, 15 nt, Artificial Sequence
  Description of Artificial Sequence: Synthetic oligonucleotide
caccaaaaucaagca

SEQ ID NO: 430 - RNA, 15 nt, Artificial Sequence
  Description of Artificial Sequence: Synthetic oligonucleotide
ggaggcuccaucaua

SEQ ID NO: 431 - RNA, 15 nt, Artificial Sequence
  Description of Artificial Sequence: Synthetic oligonucleotide
cagauucucaacgaa

SEQ ID NO: 432 - RNA, 15 nt, Artificial Sequence
  Description of Artificial Sequence: Synthetic oligonucleotide
uguaaaauggauaaa

SEQ ID NO: 433 - RNA, 15 nt, Artificial Sequence
  Description of Artificial Sequence: Synthetic oligonucleotide
gagugaauaggacaa

SEQ ID NO: 434 - RNA, 15 nt, Artificial Sequence
  Description of Artificial Sequence: Synthetic oligonucleotide
agaacuggauauuga

SEQ ID NO: 435 - RNA, 15 nt, Artificial Sequence
  Description of Artificial Sequence: Synthetic oligonucleotide
aaagaaucucaaaga

SEQ ID NO: 436 - RNA, 15 nt, Artificial Sequence
  Description of Artificial Sequence: Synthetic oligonucleotide
cacugccaagaguga

SEQ ID NO: 437 - RNA, 15 nt, Artificial Sequence
  Description of Artificial Sequence: Synthetic oligonucleotide
gguauucuuucaaga

SEQ ID NO: 438 - RNA, 15 nt, Artificial Sequence
  Description of Artificial Sequence: Synthetic oligonucleotide
guaugauauugccua

SEQ ID NO: 439 - RNA, 15 nt, Artificial Sequence
  Description of Artificial Sequence: Synthetic oligonucleotide
agugaauuacacaga

SEQ ID NO: 440 - RNA, 15 nt, Artificial Sequence
  Description of Artificial Sequence: Synthetic oligonucleotide
aaccaguggauauua

SEQ ID NO: 441 - RNA, 15 nt, Artificial Sequence
  Description of Artificial Sequence: Synthetic oligonucleotide
uggguauucuuucaa

SEQ ID NO: 442 - RNA, 15 nt, Artificial Sequence
  Description of Artificial Sequence: Synthetic oligonucleotide
caguggauauuaaca

SEQ ID NO: 443 - RNA, 15 nt, Artificial Sequence
  Description of Artificial Sequence: Synthetic oligonucleotide
auuuuaccaugacaa

SEQ ID NO: 444 - RNA, 15 nt, Artificial Sequence
  Description of Artificial Sequence: Synthetic oligonucleotide
auggcccaaagaaua

SEQ ID NO: 445 - RNA, 15 nt, Artificial Sequence
  Description of Artificial Sequence: Synthetic oligonucleotide
cguuggaggaacuga

SEQ ID NO: 446 - RNA, 15 nt, Artificial Sequence
  Description of Artificial Sequence: Synthetic oligonucleotide
acugaagcacaccca

SEQ ID NO: 447 - RNA, 15 nt, Artificial Sequence
  Description of Artificial Sequence: Synthetic oligonucleotide
uuaaagcuuucuuca

SEQ ID NO: 448 - RNA, 15 nt, Artificial Sequence
  Description of Artificial Sequence: Synthetic oligonucleotide
ggucuuuucaggaua

SEQ ID NO: 449 - RNA, 15 nt, Artificial Sequence
  Description of Artificial Sequence: Synthetic oligonucleotide
acuuaaagcuuucua

SEQ ID NO: 450 - RNA, 15 nt, Artificial Sequence
  Description of Artificial Sequence: Synthetic oligonucleotide
uuacagaaacacuga

SEQ ID NO: 451 - RNA, 15 nt, Artificial Sequence
  Description of Artificial Sequence: Synthetic oligonucleotide
agauuuugcguguca

SEQ ID NO: 452 - RNA, 15 nt, Artificial Sequence
  Description of Artificial Sequence: Synthetic oligonucleotide
agcaaugcucacaca

SEQ ID NO: 453 - RNA, 15 nt, Artificial Sequence
  Description of Artificial Sequence: Synthetic oligonucleotide
aagcucuuucuggua

SEQ ID NO: 454 - RNA, 15 nt, Artificial Sequence
  Description of Artificial Sequence: Synthetic oligonucleotide
ccugugcacuuucua

SEQ ID NO: 455 - RNA, 15 nt, Artificial Sequence
  Description of Artificial Sequence: Synthetic oligonucleotide
caaucugaaauaaaa

SEQ ID NO: 456 - RNA, 15 nt, Artificial Sequence
  Description of Artificial Sequence: Synthetic oligonucleotide
agaagaacuggauaa

SEQ ID NO: 457 - RNA, 15 nt, Artificial Sequence
  Description of Artificial Sequence: Synthetic oligonucleotide
cuucacuuucacgga

SEQ ID NO: 458 - RNA, 15 nt, Artificial Sequence
  Description of Artificial Sequence: Synthetic oligonucleotide
uacugaagcacacca

SEQ ID NO: 459 - RNA, 15 nt, Artificial Sequence
  Description of Artificial Sequence: Synthetic oligonucleotide
gaggcccucugucca

SEQ ID NO: 460 - RNA, 15 nt, Artificial Sequence
  Description of Artificial Sequence: Synthetic oligonucleotide
aggaugauuuucuua

SEQ ID NO: 461 - RNA, 15 nt, Artificial Sequence
  Description of Artificial Sequence: Synthetic oligonucleotide
cccaaagaaucucaa

SEQ ID NO: 462 - RNA, 15 nt, Artificial Sequence
  Description of Artificial Sequence: Synthetic oligonucleotide
ucuccuuaaaacaua

SEQ ID NO: 463 - RNA, 15 nt, Artificial Sequence
  Description of Artificial Sequence: Synthetic oligonucleotide
ugccagaaacuguga

SEQ ID NO: 464 - RNA, 15 nt, Artificial Sequence
  Description of Artificial Sequence: Synthetic oligonucleotide
gaacuggauauugua

SEQ ID NO: 465 - RNA, 15 nt, Artificial Sequence
  Description of Artificial Sequence: Synthetic oligonucleotide
uuucuggugaaugua

SEQ ID NO: 466 - RNA, 15 nt, Artificial Sequence
  Description of Artificial Sequence: Synthetic oligonucleotide
augauauugccuuga

SEQ ID NO: 467 - RNA, 15 nt, Artificial Sequence
  Description of Artificial Sequence: Synthetic oligonucleotide
caggaucguuggaga

SEQ ID NO: 468 - RNA, 15 nt, Artificial Sequence
  Description of Artificial Sequence: Synthetic oligonucleotide
cuuucugguuucaga

SEQ ID NO: 469 - RNA, 15 nt, Artificial Sequence
  Description of Artificial Sequence: Synthetic oligonucleotide
uugcaagggagauua

SEQ ID NO: 470 - RNA, 15 nt, Artificial Sequence
  Description of Artificial Sequence: Synthetic oligonucleotide
cagugaauuacacaa

SEQ ID NO: 471 - RNA, 15 nt, Artificial Sequence
  Description of Artificial Sequence: Synthetic oligonucleotide
gauuuucacugaaaa

SEQ ID NO: 472 - RNA, 15 nt, Artificial Sequence
  Description of Artificial Sequence: Synthetic oligonucleotide
uuucaggaugauuua

SEQ ID NO: 473 - RNA, 15 nt, Artificial Sequence
  Description of Artificial Sequence: Synthetic oligonucleotide
ggauaaugaguguaa

SEQ ID NO: 474 - RNA, 15 nt, Artificial Sequence
  Description of Artificial Sequence: Synthetic oligonucleotide
agaaacacugccaaa

SEQ ID NO: 475 - RNA, 15 nt, Artificial Sequence
  Description of Artificial Sequence: Synthetic oligonucleotide
auaaugaguguacca

SEQ ID NO: 476 - RNA, 15 nt, Artificial Sequence
  Description of Artificial Sequence: Synthetic oligonucleotide
ccauaugccugccua

SEQ ID NO: 477 - RNA, 15 nt, Artificial Sequence
  Description of Artificial Sequence: Synthetic oligonucleotide
cuuguugaaacugga

SEQ ID NO: 478 - RNA, 15 nt, Artificial Sequence
  Description of Artificial Sequence: Synthetic oligonucleotide
aaagggagcggccaa

SEQ ID NO: 479 - RNA, 15 nt, Artificial Sequence
  Description of Artificial Sequence: Synthetic oligonucleotide
cuggaaaccacagua

SEQ ID NO: 480 - RNA, 15 nt, Artificial Sequence
  Description of Artificial Sequence: Synthetic oligonucleotide
ggaauggcccaaaga

SEQ ID NO: 481 - RNA, 15 nt, Artificial Sequence
  Description of Artificial Sequence: Synthetic oligonucleotide
ggaugauuuucuuaa

SEQ ID NO: 482 - RNA, 15 nt, Artificial Sequence
  Description of Artificial Sequence: Synthetic oligonucleotide
cugaaauaaaagaga

SEQ ID NO: 483 - RNA, 15 nt, Artificial Sequence
  Description of Artificial Sequence: Synthetic oligonucleotide
aagaaucucaaagaa

SEQ ID NO: 484 - RNA, 15 nt, Artificial Sequence
  Description of Artificial Sequence: Synthetic oligonucleotide
gaggcuccaucauua

SEQ ID NO: 485 - RNA, 15 nt, Artificial Sequence
  Description of Artificial Sequence: Synthetic oligonucleotide
uucugccauucuuca

SEQ ID NO: 486 - RNA, 15 nt, Artificial Sequence
  Description of Artificial Sequence: Synthetic oligonucleotide
aggcuccaucauuga

SEQ ID NO: 487 - RNA, 15 nt, Artificial Sequence
  Description of Artificial Sequence: Synthetic oligonucleotide
uguggaggcuccaua

SEQ ID NO: 488 - RNA, 15 nt, Artificial Sequence
  Description of Artificial Sequence: Synthetic oligonucleotide
acugauuucuuggga

SEQ ID NO: 489 - RNA, 15 nt, Artificial Sequence
  Description of Artificial Sequence: Synthetic oligonucleotide
cuguguggaggcuca

SEQ ID NO: 490 - RNA, 15 nt, Artificial Sequence
  Description of Artificial Sequence: Synthetic oligonucleotide
ugauuucuugggaga

SEQ ID NO: 491 - RNA, 15 nt, Artificial Sequence
  Description of Artificial Sequence: Synthetic oligonucleotide
caccuguguggagga

SEQ ID NO: 492 - RNA, 15 nt, Artificial Sequence
  Description of Artificial Sequence: Synthetic oligonucleotide
ggcuccaucauugga

SEQ ID NO: 493 - RNA, 15 nt, Artificial Sequence
  Description of Artificial Sequence: Synthetic oligonucleotide
uccaucauuggaaaa

SEQ ID NO: 494 - RNA, 15 nt, Artificial Sequence
  Description of Artificial Sequence: Synthetic oligonucleotide
cugauuucuugggaa

SEQ ID NO: 495 - RNA, 15 nt, Artificial Sequence
  Description of Artificial Sequence: Synthetic oligonucleotide
ccuguguggaggcua

SEQ ID NO: 496 - RNA, 15 nt, Artificial Sequence
  Description of Artificial Sequence: Synthetic oligonucleotide
uucuugggagaagaa

SEQ ID NO: 497 - RNA, 15 nt, Artificial Sequence
  Description of Artificial Sequence: Synthetic oligonucleotide
ccaucauuggaaaca

SEQ ID NO: 498 - RNA, 15 nt, Artificial Sequence
  Description of Artificial Sequence: Synthetic oligonucleotide
gcuccaucauuggaa

SEQ ID NO: 499 - RNA, 15 nt, Artificial Sequence
  Description of Artificial Sequence: Synthetic oligonucleotide
guguggaggcuccaa

SEQ ID NO: 500 - RNA, 15 nt, Artificial Sequence
  Description of Artificial Sequence: Synthetic oligonucleotide
accuguguggaggca

SEQ ID NO: 501 - RNA, 19 nt, Artificial Sequence
  Description of Artificial Sequence: Synthetic oligonucleotide
ucaaaaucuuaggugacuc

SEQ ID NO: 502 - RNA, 19 nt, Artificial Sequence
  Description of Artificial Sequence: Synthetic oligonucleotide
uauugauuuaaaaugccac

SEQ ID NO: 503 - RNA, 19 nt, Artificial Sequence
  Description of Artificial Sequence: Synthetic oligonucleotide
uagaaaucgcugcuguccu

SEQ ID NO: 504 - RNA, 19 nt, Artificial Sequence
  Description of Artificial Sequence: Synthetic oligonucleotide
uauaagaaaaucauccuga

SEQ ID NO: 505 - RNA, 19 nt, Artificial Sequence
  Description of Artificial Sequence: Synthetic oligonucleotide
uaaacaccguauuagggaa

SEQ ID NO: 506 - RNA, 19 nt, Artificial Sequence
  Description of Artificial Sequence: Synthetic oligonucleotide
uaaaucagugucaugguaa

SEQ ID NO: 507 - RNA, 19 nt, Artificial Sequence
  Description of Artificial Sequence: Synthetic oligonucleotide
uauacccgcuuucugccau

SEQ ID NO: 508 - RNA, 19 nt, Artificial Sequence
  Description of Artificial Sequence: Synthetic oligonucleotide
uagauguuuuaaggagaca

SEQ ID NO: 509 - RNA, 19 nt, Artificial Sequence
  Description of Artificial Sequence: Synthetic oligonucleotide
ugguaucuuggcuuucugg

SEQ ID NO: 510 - RNA, 19 nt, Artificial Sequence
  Description of Artificial Sequence: Synthetic oligonucleotide
ucucuguaucucuucuggc

SEQ ID NO: 511 - RNA, 19 nt, Artificial Sequence
  Description of Artificial Sequence: Synthetic oligonucleotide
uauggauuauuauuucuug

SEQ ID NO: 512 - RNA, 19 nt, Artificial Sequence
  Description of Artificial Sequence: Synthetic oligonucleotide
uagccagauuagaaagugc

SEQ ID NO: 513 - RNA, 19 nt, Artificial Sequence
  Description of Artificial Sequence: Synthetic oligonucleotide
uagcggacggcauuggugc

SEQ ID NO: 514 - RNA, 19 nt, Artificial Sequence
  Description of Artificial Sequence: Synthetic oligonucleotide
uauuucagauugauuuaaa

SEQ ID NO: 515 - RNA, 19 nt, Artificial Sequence
  Description of Artificial Sequence: Synthetic oligonucleotide
uuugucucuuaguuuucug

SEQ ID NO: 516 - RNA, 19 nt, Artificial Sequence
  Description of Artificial Sequence: Synthetic oligonucleotide
uagaacacugggaugcugu

SEQ ID NO: 517 - RNA, 19 nt, Artificial Sequence
  Description of Artificial Sequence: Synthetic oligonucleotide
uccacuugauauaagaaaa

SEQ ID NO: 518 - RNA, 19 nt, Artificial Sequence
  Description of Artificial Sequence: Synthetic oligonucleotide
ucauuuucuuacaaacacc

SEQ ID NO: 519 - RNA, 19 nt, Artificial Sequence
  Description of Artificial Sequence: Synthetic oligonucleotide
uuaaugcguguacugggca

SEQ ID NO: 520 - RNA, 19 nt, Artificial Sequence
  Description of Artificial Sequence: Synthetic oligonucleotide
uaggacagagggccucccg

SEQ ID NO: 521 - RNA, 19 nt, Artificial Sequence
  Description of Artificial Sequence: Synthetic oligonucleotide
ucaaccgggaugaugagug

SEQ ID NO: 522 - RNA, 19 nt, Artificial Sequence
  Description of Artificial Sequence: Synthetic oligonucleotide
ugacaaagauuucuuugag

SEQ ID NO: 523 - RNA, 19 nt, Artificial Sequence
  Description of Artificial Sequence: Synthetic oligonucleotide
ugaggaagcaugcuggcac

SEQ ID NO: 524 - RNA, 19 nt, Artificial Sequence
  Description of Artificial Sequence: Synthetic oligonucleotide
uggaaaaugucccuaauac

SEQ ID NO: 525 - RNA, 19 nt, Artificial Sequence
  Description of Artificial Sequence: Synthetic oligonucleotide
uuuaaguaacacuugcccu

SEQ ID NO: 526 - RNA, 19 nt, Artificial Sequence
  Description of Artificial Sequence: Synthetic oligonucleotide
ucaauaucauacccgcuuu

SEQ ID NO: 527 - RNA, 19 nt, Artificial Sequence
  Description of Artificial Sequence: Synthetic oligonucleotide
uaaauguaccacuugauau

SEQ ID NO: 528 - RNA, 19 nt, Artificial Sequence
  Description of Artificial Sequence: Synthetic oligonucleotide
uagaaaaucauccugaaaa

SEQ ID NO: 529 - RNA, 19 nt, Artificial Sequence
  Description of Artificial Sequence: Synthetic oligonucleotide
uuaacacuugcccuucccu

SEQ ID NO: 530 - RNA, 19 nt, Artificial Sequence
  Description of Artificial Sequence: Synthetic oligonucleotide
uagcauuuucuuacaaaca

SEQ ID NO: 531 - RNA, 19 nt, Artificial Sequence
  Description of Artificial Sequence: Synthetic oligonucleotide
ucaaacaccguauuaggga

SEQ ID NO: 532 - RNA, 19 nt, Artificial Sequence
  Description of Artificial Sequence: Synthetic oligonucleotide
uagcggcuguuaauaucca

SEQ ID NO: 533 - RNA, 19 nt, Artificial Sequence
  Description of Artificial Sequence: Synthetic oligonucleotide
ugagcggcuguuaauaucc

SEQ ID NO: 534 - RNA, 19 nt, Artificial Sequence
  Description of Artificial Sequence: Synthetic oligonucleotide
ugagacaaagauuucuuug

SEQ ID NO: 535 - RNA, 19 nt, Artificial Sequence
  Description of Artificial Sequence: Synthetic oligonucleotide
uuggguuauuuuauguccu

SEQ ID NO: 536 - RNA, 19 nt, Artificial Sequence
  Description of Artificial Sequence: Synthetic oligonucleotide
ugagccaugacacugucga

SEQ ID NO: 537 - RNA, 19 nt, Artificial Sequence
  Description of Artificial Sequence: Synthetic oligonucleotide
ucagauuagaaagugcaca

SEQ ID NO: 538 - RNA, 19 nt, Artificial Sequence
  Description of Artificial Sequence: Synthetic oligonucleotide
uagaauacccagaaaucgc

SEQ ID NO: 539 - RNA, 19 nt, Artificial Sequence
  Description of Artificial Sequence: Synthetic oligonucleotide
ucagauguuuuaaggagac

SEQ ID NO: 540 - RNA, 19 nt, Artificial Sequence
  Description of Artificial Sequence: Synthetic oligonucleotide
uuguauccagagaugccuc

SEQ ID NO: 541 - RNA, 19 nt, Artificial Sequence
  Description of Artificial Sequence: Synthetic oligonucleotide
ugagucacacauucaccag

SEQ ID NO: 542 - RNA, 19 nt, Artificial Sequence
  Description of Artificial Sequence: Synthetic oligonucleotide
ucaaagaaagauguguccu

SEQ ID NO: 543 - RNA, 19 nt, Artificial Sequence
  Description of Artificial Sequence: Synthetic oligonucleotide
uaccacuugauauaagaaa

SEQ ID NO: 544 - RNA, 19 nt, Artificial Sequence
  Description of Artificial Sequence: Synthetic oligonucleotide
uaagaaagcuuuaaguaac

SEQ ID NO: 545 - RNA, 19 nt, Artificial Sequence
  Description of Artificial Sequence: Synthetic oligonucleotide
uuuauuucagauugauuua

SEQ ID NO: 546 - RNA, 19 nt, Artificial Sequence
  Description of Artificial Sequence: Synthetic oligonucleotide
uuggugugagcauugcuug

SEQ ID NO: 547 - RNA, 19 nt, Artificial Sequence
  Description of Artificial Sequence: Synthetic oligonucleotide
uaucauccugaaaagaccu

SEQ ID NO: 548 - RNA, 19 nt, Artificial Sequence
  Description of Artificial Sequence: Synthetic oligonucleotide
ugugagcauugcuugaaag

SEQ ID NO: 549 - RNA, 19 nt, Artificial Sequence
  Description of Artificial Sequence: Synthetic oligonucleotide
ucuguaucucuucuggcac

SEQ ID NO: 550 - RNA, 19 nt, Artificial Sequence
  Description of Artificial Sequence: Synthetic oligonucleotide
uaccuuaauguguauccag

SEQ ID NO: 551 - RNA, 19 nt, Artificial Sequence
  Description of Artificial Sequence: Synthetic oligonucleotide
uaucauggauuauuauuuc

SEQ ID NO: 552 - RNA, 19 nt, Artificial Sequence
  Description of Artificial Sequence: Synthetic oligonucleotide
ucaaagauuucuuugagau

SEQ ID NO: 553 - RNA, 19 nt, Artificial Sequence
  Description of Artificial Sequence: Synthetic oligonucleotide
ugaaguauuuuaguuggag

SEQ ID NO: 554 - RNA, 19 nt, Artificial Sequence
  Description of Artificial Sequence: Synthetic oligonucleotide
uagauugauuuaaaaugcc

SEQ ID NO: 555 - RNA, 19 nt, Artificial Sequence
  Description of Artificial Sequence: Synthetic oligonucleotide
uggguaucuuggcuuucug

SEQ ID NO: 556 - RNA, 19 nt, Artificial Sequence
  Description of Artificial Sequence: Synthetic oligonucleotide
uaggagacaaagauuucuu

SEQ ID NO: 557 - RNA, 19 nt, Artificial Sequence
  Description of Artificial Sequence: Synthetic oligonucleotide
ugucaugguaaaaugaaga

SEQ ID NO: 558 - RNA, 19 nt, Artificial Sequence
  Description of Artificial Sequence: Synthetic oligonucleotide
uauauccaguucuucuccc

SEQ ID NO: 559 - RNA, 19 nt, Artificial Sequence
  Description of Artificial Sequence: Synthetic oligonucleotide
uaauauccaguucuucucc

SEQ ID NO: 560 - RNA, 19 nt, Artificial Sequence
  Description of Artificial Sequence: Synthetic oligonucleotide
ucugugguuuccaguuuca

SEQ ID NO: 561 - RNA, 19 nt, Artificial Sequence
  Description of Artificial Sequence: Synthetic oligonucleotide
uagauuagaaagugcacag

SEQ ID NO: 562 - RNA, 19 nt, Artificial Sequence
  Description of Artificial Sequence: Synthetic oligonucleotide
uagaaaucagugucauggu

SEQ ID NO: 563 - RNA, 19 nt, Artificial Sequence
  Description of Artificial Sequence: Synthetic oligonucleotide
uuggauuauuauuucuuga

SEQ ID NO: 564 - RNA, 19 nt, Artificial Sequence
  Description of Artificial Sequence: Synthetic oligonucleotide
uccagauuagaaagugcac

SEQ ID NO: 565 - RNA, 19 nt, Artificial Sequence
  Description of Artificial Sequence: Synthetic oligonucleotide
ucucauuauccauuuuaca

SEQ ID NO: 566 - RNA, 19 nt, Artificial Sequence
  Description of Artificial Sequence: Synthetic oligonucleotide
uuugggccauuccugggaa

SEQ ID NO: 567 - RNA, 19 nt, Artificial Sequence
  Description of Artificial Sequence: Synthetic oligonucleotide
uugggcuugauuuuggugg

SEQ ID NO: 568 - RNA, 19 nt, Artificial Sequence
  Description of Artificial Sequence: Synthetic oligonucleotide
ucagauugauuuaaaaugc

SEQ ID NO: 569 - RNA, 19 nt, Artificial Sequence
  Description of Artificial Sequence: Synthetic oligonucleotide
uaagcaaccgggaugauga

SEQ ID NO: 570 - RNA, 19 nt, Artificial Sequence
  Description of Artificial Sequence: Synthetic oligonucleotide
ucuuaauguguauccagag

SEQ ID NO: 571 - RNA, 19 nt, Artificial Sequence
  Description of Artificial Sequence: Synthetic oligonucleotide
uguaauucacugugguuuc

SEQ ID NO: 572 - RNA, 19 nt, Artificial Sequence
  Description of Artificial Sequence: Synthetic oligonucleotide
uacauuucuaucuccuuug

SEQ ID NO: 573 - RNA, 19 nt, Artificial Sequence
  Description of Artificial Sequence: Synthetic oligonucleotide
ucacugguuuccaaugaug

SEQ ID NO: 574 - RNA, 19 nt, Artificial Sequence
  Description of Artificial Sequence: Synthetic oligonucleotide
ugaaucuguguaauucacu

SEQ ID NO: 575 - RNA, 19 nt, Artificial Sequence
  Description of Artificial Sequence: Synthetic oligonucleotide
uguccuauucacucuuggc

SEQ ID NO: 576 - RNA, 19 nt, Artificial Sequence
  Description of Artificial Sequence: Synthetic oligonucleotide
uagcauugcuugaaagaau

SEQ ID NO: 577 - RNA, 19 nt, Artificial Sequence
  Description of Artificial Sequence: Synthetic oligonucleotide
uaauacccagaaaucgcug

SEQ ID NO: 578 - RNA, 19 nt, Artificial Sequence
  Description of Artificial Sequence: Synthetic oligonucleotide
uauuauuauuucuugaacc

SEQ ID NO: 579 - RNA, 19 nt, Artificial Sequence
  Description of Artificial Sequence: Synthetic oligonucleotide
uaaguauuuuaguuggaga

SEQ ID NO: 580 - RNA, 19 nt, Artificial Sequence
  Description of Artificial Sequence: Synthetic oligonucleotide
ugaauccaguccacguacu

SEQ ID NO: 581 - RNA, 19 nt, Artificial Sequence
  Description of Artificial Sequence: Synthetic oligonucleotide
uagacaaagauuucuuuga

SEQ ID NO: 582 - RNA, 19 nt, Artificial Sequence
  Description of Artificial Sequence: Synthetic oligonucleotide
uacaggauuucagugaaaa

SEQ ID NO: 583 - RNA, 19 nt, Artificial Sequence
  Description of Artificial Sequence: Synthetic oligonucleotide
uaacaaggcaauaucauac

SEQ ID NO: 584 - RNA, 19 nt, Artificial Sequence
  Description of Artificial Sequence: Synthetic oligonucleotide
uaaggcaauaucauacccg

SEQ ID NO: 585 - RNA, 19 nt, Artificial Sequence
  Description of Artificial Sequence: Synthetic oligonucleotide
uauacccagaaaucgcugc

SEQ ID NO: 586 - RNA, 19 nt, Artificial Sequence
  Description of Artificial Sequence: Synthetic oligonucleotide
ugauugauuuaaaaugcca

SEQ ID NO: 587 - RNA, 19 nt, Artificial Sequence
  Description of Artificial Sequence: Synthetic oligonucleotide
uccuauucacucuuggcag

SEQ ID NO: 588 - RNA, 19 nt, Artificial Sequence
  Description of Artificial Sequence: Synthetic oligonucleotide
uguagacacgcaaaaucuu

SEQ ID NO: 589 - RNA, 19 nt, Artificial Sequence
  Description of Artificial Sequence: Synthetic oligonucleotide
uugaguuuucuccagaauc

SEQ ID NO: 590 - RNA, 19 nt, Artificial Sequence
  Description of Artificial Sequence: Synthetic oligonucleotide
uauuucuuugagauucuuu

SEQ ID NO: 591 - RNA, 19 nt, Artificial Sequence
  Description of Artificial Sequence: Synthetic oligonucleotide
uuauaagaaaaucauccug

SEQ ID NO: 592 - RNA, 19 nt, Artificial Sequence
  Description of Artificial Sequence: Synthetic oligonucleotide
uaaaaucuuaggugacucu

SEQ ID NO: 593 - RNA, 19 nt, Artificial Sequence
  Description of Artificial Sequence: Synthetic oligonucleotide
uacacugggaugcugugcc

SEQ ID NO: 594 - RNA, 19 nt, Artificial Sequence
  Description of Artificial Sequence: Synthetic oligonucleotide
uugcacaggauuucaguga

SEQ ID NO: 595 - RNA, 19 nt, Artificial Sequence
  Description of Artificial Sequence: Synthetic oligonucleotide
uauacaagccagauuagaa

SEQ ID NO: 596 - RNA, 19 nt, Artificial Sequence
  Description of Artificial Sequence: Synthetic oligonucleotide
uugugguuuccaguuucaa

SEQ ID NO: 597 - RNA, 19 nt, Artificial Sequence
  Description of Artificial Sequence: Synthetic oligonucleotide
uugcccuucccuucguugc

SEQ ID NO: 598 - RNA, 19 nt, Artificial Sequence
  Description of Artificial Sequence: Synthetic oligonucleotide
uaaaaucauccugaaaaga

SEQ ID NO: 599 - RNA, 19 nt, Artificial Sequence
  Description of Artificial Sequence: Synthetic oligonucleotide
uccaagaaaucagugucau

SEQ ID NO: 600 - RNA, 19 nt, Artificial Sequence
  Description of Artificial Sequence: Synthetic oligonucleotide
uggcauaugggucguugag

SEQ ID NO: 601 - RNA, 19 nt, Artificial Sequence
  Description of Artificial Sequence: Synthetic oligonucleotide
uagaaucuguguaauucac

SEQ ID NO: 602 - RNA, 19 nt, Artificial Sequence
  Description of Artificial Sequence: Synthetic oligonucleotide
uauccaguccacguacucg

SEQ ID NO: 603 - RNA, 19 nt, Artificial Sequence
  Description of Artificial Sequence: Synthetic oligonucleotide
uccucuguaucucuucugg

SEQ ID NO: 604 - RNA, 19 nt, Artificial Sequence
  Description of Artificial Sequence: Synthetic oligonucleotide
ugcacaggauuucagugaa

SEQ ID NO: 605 - RNA, 19 nt, Artificial Sequence
  Description of Artificial Sequence: Synthetic oligonucleotide
uguaaaaugaagaauggca

SEQ ID NO: 606 - RNA, 19 nt, Artificial Sequence
  Description of Artificial Sequence: Synthetic oligonucleotide
ugucguugagaaucugugu

SEQ ID NO: 607 - RNA, 19 nt, Artificial Sequence
  Description of Artificial Sequence: Synthetic oligonucleotide
ugcaacaauauccaguucu

SEQ ID NO: 608 - RNA, 19 nt, Artificial Sequence
  Description of Artificial Sequence: Synthetic oligonucleotide
ucagcggacggcauuggug

SEQ ID NO: 609 - RNA, 19 nt, Artificial Sequence
  Description of Artificial Sequence: Synthetic oligonucleotide
ugaaagcuuuaaguaacac

SEQ ID NO: 610 - RNA, 19 nt, Artificial Sequence
  Description of Artificial Sequence: Synthetic oligonucleotide
ugcaguguuucuguaacac

SEQ ID NO: 611 - RNA, 19 nt, Artificial Sequence
  Description of Artificial Sequence: Synthetic oligonucleotide
ugagaaucuguguaauuca

SEQ ID NO: 612 - RNA, 19 nt, Artificial Sequence
  Description of Artificial Sequence: Synthetic oligonucleotide
uuccaguccacguacucga

SEQ ID NO: 613 - RNA, 19 nt, Artificial Sequence
  Description of Artificial Sequence: Synthetic oligonucleotide
uugugagcauugcuugaaa

SEQ ID NO: 614 - RNA, 19 nt, Artificial Sequence
  Description of Artificial Sequence: Synthetic oligonucleotide
uccgggaugaugagugcag

SEQ ID NO: 615 - RNA, 19 nt, Artificial Sequence
  Description of Artificial Sequence: Synthetic oligonucleotide
uccacuuuaucgagcuucg

SEQ ID NO: 616 - RNA, 19 nt, Artificial Sequence
  Description of Artificial Sequence: Synthetic oligonucleotide
ucauuauccauuuuacaca

SEQ ID NO: 617 - RNA, 19 nt, Artificial Sequence
  Description of Artificial Sequence: Synthetic oligonucleotide
uaaccgggaugaugagugc

SEQ ID NO: 618 - RNA, 19 nt, Artificial Sequence
  Description of Artificial Sequence: Synthetic oligonucleotide
uuucuuugggccauuccug

SEQ ID NO: 619 - RNA, 19 nt, Artificial Sequence
  Description of Artificial Sequence: Synthetic oligonucleotide
ucuaaggguaucuuggcuu

SEQ ID NO: 620 - RNA, 19 nt, Artificial Sequence
  Description of Artificial Sequence: Synthetic oligonucleotide
uuuggugugagcauugcuu

SEQ ID NO: 621 - RNA, 19 nt, Artificial Sequence
  Description of Artificial Sequence: Synthetic oligonucleotide
ucauaugggucguugagaa

SEQ ID NO: 622 - RNA, 19 nt, Artificial Sequence
  Description of Artificial Sequence: Synthetic oligonucleotide
uuuaauguguauccagaga

SEQ ID NO: 623 - RNA, 19 nt, Artificial Sequence
  Description of Artificial Sequence: Synthetic oligonucleotide
uucagauguuuuaaggaga

SEQ ID NO: 624 - RNA, 19 nt, Artificial Sequence
  Description of Artificial Sequence: Synthetic oligonucleotide
uuuccaaugauggagccuc

SEQ ID NO: 625 - RNA, 19 nt, Artificial Sequence
  Description of Artificial Sequence: Synthetic oligonucleotide
uagaauccaguccacguac

SEQ ID NO: 626 - RNA, 19 nt, Artificial Sequence
  Description of Artificial Sequence: Synthetic oligonucleotide
uuuugagauucuuugggcc

SEQ ID NO: 627 - RNA, 19 nt, Artificial Sequence
  Description of Artificial Sequence: Synthetic oligonucleotide
uaaucauccugaaaagacc

SEQ ID NO: 628 - RNA, 19 nt, Artificial Sequence
  Description of Artificial Sequence: Synthetic oligonucleotide
uagacacgcaaaaucuuag

SEQ ID NO: 629 - RNA, 19 nt, Artificial Sequence
  Description of Artificial Sequence: Synthetic oligonucleotide
ucguacucgaccacguugg

SEQ ID NO: 630 - RNA, 19 nt, Artificial Sequence
  Description of Artificial Sequence: Synthetic oligonucleotide
ucauccagucacccagcaa

SEQ ID NO: 631 - RNA, 19 nt, Artificial Sequence
  Description of Artificial Sequence: Synthetic oligonucleotide
uaacacugggaugcugugc

SEQ ID NO: 632 - RNA, 19 nt, Artificial Sequence
  Description of Artificial Sequence: Synthetic oligonucleotide
ucagaaagagcuuugcucu

SEQ ID NO: 633 - RNA, 19 nt, Artificial Sequence
  Description of Artificial Sequence: Synthetic oligonucleotide
uuucuuugagauucuuugg

SEQ ID NO: 634 - RNA, 19 nt, Artificial Sequence
  Description of Artificial Sequence: Synthetic oligonucleotide
uagcaacaauauccaguuc

SEQ ID NO: 635 - RNA, 19 nt, Artificial Sequence
  Description of Artificial Sequence: Synthetic oligonucleotide
uaccacuuuaucgagcuuc

SEQ ID NO: 636 - RNA, 19 nt, Artificial Sequence
  Description of Artificial Sequence: Synthetic oligonucleotide
ucccuucccuucguugcag

SEQ ID NO: 637 - RNA, 19 nt, Artificial Sequence
  Description of Artificial Sequence: Synthetic oligonucleotide
ucgcaaaaucuuaggugac

SEQ ID NO: 638 - RNA, 19 nt, Artificial Sequence
  Description of Artificial Sequence: Synthetic oligonucleotide
uagcguguuacuguggagg

SEQ ID NO: 639 - RNA, 19 nt, Artificial Sequence
  Description of Artificial Sequence: Synthetic oligonucleotide
ucuccuucccuguagccgg

SEQ ID NO: 640 - RNA, 19 nt, Artificial Sequence
  Description of Artificial Sequence: Synthetic oligonucleotide
uguccucuguaucucuucu

SEQ ID NO: 641 - RNA, 19 nt, Artificial Sequence
  Description of Artificial Sequence: Synthetic oligonucleotide
uguaucuuggcuuucugga

SEQ ID NO: 642 - RNA, 19 nt, Artificial Sequence
  Description of Artificial Sequence: Synthetic oligonucleotide
ucucuuggcaguguuucug

SEQ ID NO: 643 - RNA, 19 nt, Artificial Sequence
  Description of Artificial Sequence: Synthetic oligonucleotide
ugaaaucagugucauggua

SEQ ID NO: 644 - RNA, 19 nt, Artificial Sequence
  Description of Artificial Sequence: Synthetic oligonucleotide
ucuucccuguagccggcac

SEQ ID NO: 645 - RNA, 19 nt, Artificial Sequence
  Description of Artificial Sequence: Synthetic oligonucleotide
ucuggccgcucccuuugag

SEQ ID NO: 646 - RNA, 19 nt, Artificial Sequence
  Description of Artificial Sequence: Synthetic oligonucleotide
ucacgcaaaaucuuaggug

SEQ ID NO: 647 - RNA, 19 nt, Artificial Sequence
  Description of Artificial Sequence: Synthetic oligonucleotide
ugaaaccagaaagagcuuu

SEQ ID NO: 648 - RNA, 19 nt, Artificial Sequence
  Description of Artificial Sequence: Synthetic oligonucleotide
uaaagcuuuaaguaacacu

SEQ ID NO: 649 - RNA, 19 nt, Artificial Sequence
  Description of Artificial Sequence: Synthetic oligonucleotide
uacaagccagauuagaaag

SEQ ID NO: 650 - RNA, 19 nt, Artificial Sequence
  Description of Artificial Sequence: Synthetic oligonucleotide
uacucauuauccauuuuac

SEQ ID NO: 651 - RNA, 19 nt, Artificial Sequence
  Description of Artificial Sequence: Synthetic oligonucleotide
uccugaaaagaccuuguug

SEQ ID NO: 652 - RNA, 19 nt, Artificial Sequence
  Description of Artificial Sequence: Synthetic oligonucleotide
ugguuuccaaugauggagc

SEQ ID NO: 653 - RNA, 19 nt, Artificial Sequence
  Description of Artificial Sequence: Synthetic oligonucleotide
ucaguuucuggcaggccuc

SEQ ID NO: 654 - RNA, 19 nt, Artificial Sequence
  Description of Artificial Sequence: Synthetic oligonucleotide
uauggcagaacacugggau

SEQ ID NO: 655 - RNA, 19 nt, Artificial Sequence
  Description of Artificial Sequence: Synthetic oligonucleotide
uagauuucuuugagauucu

SEQ ID NO: 656 - RNA, 19 nt, Artificial Sequence
  Description of Artificial Sequence: Synthetic oligonucleotide
uguuuccaguuucaacaag

SEQ ID NO: 657 - RNA, 19 nt, Artificial Sequence
  Description of Artificial Sequence: Synthetic oligonucleotide
uuccucuguaucucuucug

SEQ ID NO: 658 - RNA, 19 nt, Artificial Sequence
  Description of Artificial Sequence: Synthetic oligonucleotide
ucauccugaaaagaccuug

SEQ ID NO: 659 - RNA, 19 nt, Artificial Sequence
  Description of Artificial Sequence: Synthetic oligonucleotide
uuugaguuuucuccagaau

SEQ ID NO: 660 - RNA, 19 nt, Artificial Sequence
  Description of Artificial Sequence: Synthetic oligonucleotide
uaauucacugugguuucca

SEQ ID NO: 661 - RNA, 19 nt, Artificial Sequence
  Description of Artificial Sequence: Synthetic oligonucleotide
uaagauuucuuugagauuc

SEQ ID NO: 662 - RNA, 19 nt, Artificial Sequence
  Description of Artificial Sequence: Synthetic oligonucleotide
uggagacaaagauuucuuu

SEQ ID NO: 663 - RNA, 19 nt, Artificial Sequence
  Description of Artificial Sequence: Synthetic oligonucleotide
ugaaaaucauccugaaaag

SEQ ID NO: 664 - RNA, 19 nt, Artificial Sequence
  Description of Artificial Sequence: Synthetic oligonucleotide
ucuuucugccauuuuauac

SEQ ID NO: 665 - RNA, 19 nt, Artificial Sequence
  Description of Artificial Sequence: Synthetic oligonucleotide
uaguccacguacucgacca

SEQ ID NO: 666 - RNA, 19 nt, Artificial Sequence
  Description of Artificial Sequence: Synthetic oligonucleotide
uuuaaugcguguacugggc

SEQ ID NO: 667 - RNA, 19 nt, Artificial Sequence
  Description of Artificial Sequence: Synthetic oligonucleotide
uuaauguguauccagagau

SEQ ID NO: 668 - RNA, 19 nt, Artificial Sequence
  Description of Artificial Sequence: Synthetic oligonucleotide
ugauucuuugggccauucc

SEQ ID NO: 669 - RNA, 19 nt, Artificial Sequence
  Description of Artificial Sequence: Synthetic oligonucleotide
uugaaaccagaaagagcuu

SEQ ID NO: 670 - RNA, 19 nt, Artificial Sequence
  Description of Artificial Sequence: Synthetic oligonucleotide
ucacacauucaccagaaac

SEQ ID NO: 671 - RNA, 19 nt, Artificial Sequence
  Description of Artificial Sequence: Synthetic oligonucleotide
uacaaagauuucuuugaga

SEQ ID NO: 672 - RNA, 19 nt, Artificial Sequence
  Description of Artificial Sequence: Synthetic oligonucleotide
ucauuucuaucuccuuugg

SEQ ID NO: 673 - RNA, 19 nt, Artificial Sequence
  Description of Artificial Sequence: Synthetic oligonucleotide
uuuucuguaacacugucuu

SEQ ID NO: 674 - RNA, 19 nt, Artificial Sequence
  Description of Artificial Sequence: Synthetic oligonucleotide
uggauuucagugaaaaucc

SEQ ID NO: 675 - RNA, 19 nt, Artificial Sequence
  Description of Artificial Sequence: Synthetic oligonucleotide
ucgcucccuuugagcacag

SEQ ID NO: 676 - RNA, 19 nt, Artificial Sequence
  Description of Artificial Sequence: Synthetic oligonucleotide
ucaguccacguacucgacc

SEQ ID NO: 677 - RNA, 19 nt, Artificial Sequence
  Description of Artificial Sequence: Synthetic oligonucleotide
uaggcauaugggucguuga

SEQ ID NO: 678 - RNA, 19 nt, Artificial Sequence
  Description of Artificial Sequence: Synthetic oligonucleotide
uauguccucuguaucucuu

SEQ ID NO: 679 - RNA, 19 nt, Artificial Sequence
  Description of Artificial Sequence: Synthetic oligonucleotide
ugcuugauuuuggugguac

SEQ ID NO: 680 - RNA, 19 nt, Artificial Sequence
  Description of Artificial Sequence: Synthetic oligonucleotide
uaugauggagccuccacac

SEQ ID NO: 681 - RNA, 19 nt, Artificial Sequence
  Description of Artificial Sequence: Synthetic oligonucleotide
uucguugagaaucugugua

SEQ ID NO: 682 - RNA, 19 nt, Artificial Sequence
  Description of Artificial Sequence: Synthetic oligonucleotide
uuuauccauuuuacacaac

SEQ ID NO: 683 - RNA, 19 nt, Artificial Sequence
  Description of Artificial Sequence: Synthetic oligonucleotide
uuguccuauucacucuugg

SEQ ID NO: 684 - RNA, 19 nt, Artificial Sequence
  Description of Artificial Sequence: Synthetic oligonucleotide
ucaauauccaguucuucuc

SEQ ID NO: 685 - RNA, 19 nt, Artificial Sequence
  Description of Artificial Sequence: Synthetic oligonucleotide
ucuuugagauucuuugggc

SEQ ID NO: 686 - RNA, 19 nt, Artificial Sequence
  Description of Artificial Sequence: Synthetic oligonucleotide
ucacucuuggcaguguuuc

SEQ ID NO: 687 - RNA, 19 nt, Artificial Sequence
  Description of Artificial Sequence: Synthetic oligonucleotide
ucuugaaagaauacccaga

SEQ ID NO: 688 - RNA, 19 nt, Artificial Sequence
  Description of Artificial Sequence: Synthetic oligonucleotide
uaggcaauaucauacccgc

SEQ ID NO: 689 - RNA, 19 nt, Artificial Sequence
  Description of Artificial Sequence: Synthetic oligonucleotide
ucuguguaauucacugugg

SEQ ID NO: 690 - RNA, 19 nt, Artificial Sequence
  Description of Artificial Sequence: Synthetic oligonucleotide
uaauauccacugguuucca

SEQ ID NO: 691 - RNA, 19 nt, Artificial Sequence
  Description of Artificial Sequence: Synthetic oligonucleotide
uugaaagaauacccagaaa

SEQ ID NO: 692 - RNA, 19 nt, Artificial Sequence
  Description of Artificial Sequence: Synthetic oligonucleotide
uguuaauauccacugguuu

SEQ ID NO: 693 - RNA, 19 nt, Artificial Sequence
  Description of Artificial Sequence: Synthetic oligonucleotide
uugucaugguaaaaugaag

SEQ ID NO: 694 - RNA, 19 nt, Artificial Sequence
  Description of Artificial Sequence: Synthetic oligonucleotide
uauucuuugggccauuccu

SEQ ID NO: 695 - RNA, 19 nt, Artificial Sequence
  Description of Artificial Sequence: Synthetic oligonucleotide
ucaguuccuccaacgaucc

SEQ ID NO: 696 - RNA, 19 nt, Artificial Sequence
  Description of Artificial Sequence: Synthetic oligonucleotide
ugggugugcuucaguagac

SEQ ID NO: 697 - RNA, 19 nt, Artificial Sequence
  Description of Artificial Sequence: Synthetic oligonucleotide
ugaagaaagcuuuaaguaa

SEQ ID NO: 698 - RNA, 19 nt, Artificial Sequence
  Description of Artificial Sequence: Synthetic oligonucleotide
uauccugaaaagaccuugu

SEQ ID NO: 699 - RNA, 19 nt, Artificial Sequence
  Description of Artificial Sequence: Synthetic oligonucleotide
uagaaagcuuuaaguaaca

SEQ ID NO: 700 - RNA, 19 nt, Artificial Sequence
  Description of Artificial Sequence: Synthetic oligonucleotide
ucaguguuucuguaacacu

SEQ ID NO: 701 - RNA, 19 nt, Artificial Sequence
  Description of Artificial Sequence: Synthetic oligonucleotide
ugacacgcaaaaucuuagg

SEQ ID NO: 702 - RNA, 19 nt, Artificial Sequence
  Description of Artificial Sequence: Synthetic oligonucleotide
ugugugagcauugcuugaa

SEQ ID NO: 703 - RNA, 19 nt, Artificial Sequence
  Description of Artificial Sequence: Synthetic oligonucleotide
uaccagaaagagcuuugcu

SEQ ID NO: 704 - RNA, 19 nt, Artificial Sequence
  Description of Artificial Sequence: Synthetic oligonucleotide
uagaaagugcacaggauuu

SEQ ID NO: 705 - RNA, 19 nt, Artificial Sequence
  Description of Artificial Sequence: Synthetic oligonucleotide
uuuuauuucagauugauuu

SEQ ID NO: 706 - RNA, 19 nt, Artificial Sequence
  Description of Artificial Sequence: Synthetic oligonucleotide
uuauccaguucuucuccca

SEQ ID NO: 707 - RNA, 19 nt, Artificial Sequence
  Description of Artificial Sequence: Synthetic oligonucleotide
uccgugaaagugaagagua

SEQ ID NO: 708 - RNA, 19 nt, Artificial Sequence
  Description of Artificial Sequence: Synthetic oligonucleotide
uggugugcuucaguagaca

SEQ ID NO: 709 - RNA, 19 nt, Artificial Sequence
  Description of Artificial Sequence: Synthetic oligonucleotide
uggacagagggccucccga

SEQ ID NO: 710 - RNA, 19 nt, Artificial Sequence
  Description of Artificial Sequence: Synthetic oligonucleotide
uaagaaaaucauccugaaa

SEQ ID NO: 711 - RNA, 19 nt, Artificial Sequence
  Description of Artificial Sequence: Synthetic oligonucleotide
uugagauucuuugggccau

SEQ ID NO: 712 - RNA, 19 nt, Artificial Sequence
  Description of Artificial Sequence: Synthetic oligonucleotide
uauguuuuaaggagacaaa

SEQ ID NO: 713 - RNA, 19 nt, Artificial Sequence
  Description of Artificial Sequence: Synthetic oligonucleotide
ucacaguuucuggcaggcc

SEQ ID NO: 714 - RNA, 19 nt, Artificial Sequence
  Description of Artificial Sequence: Synthetic oligonucleotide
uacaauauccaguucuucu

SEQ ID NO: 715 - RNA, 19 nt, Artificial Sequence
  Description of Artificial Sequence: Synthetic oligonucleotide
uacauucaccagaaacuga

SEQ ID NO: 716 - RNA, 19 nt, Artificial Sequence
  Description of Artificial Sequence: Synthetic oligonucleotide
ucaaggcaauaucauaccc

SEQ ID NO: 717 - RNA, 19 nt, Artificial Sequence
  Description of Artificial Sequence: Synthetic oligonucleotide
ucuccaacgauccugggcu

SEQ ID NO: 718 - RNA, 19 nt, Artificial Sequence
  Description of Artificial Sequence: Synthetic oligonucleotide
ucugaaaccagaaagagcu

SEQ ID NO: 719 - RNA, 19 nt, Artificial Sequence
  Description of Artificial Sequence: Synthetic oligonucleotide
uaaucucccuugcaagcgu

SEQ ID NO: 720 - RNA, 19 nt, Artificial Sequence
  Description of Artificial Sequence: Synthetic oligonucleotide
uuguguaauucacuguggu

SEQ ID NO: 721 - RNA, 19 nt, Artificial Sequence
  Description of Artificial Sequence: Synthetic oligonucleotide
uuuucagugaaaauccaga

SEQ ID NO: 722 - RNA, 19 nt, Artificial Sequence
  Description of Artificial Sequence: Synthetic oligonucleotide
uaaaucauccugaaaagac

SEQ ID NO: 723 - RNA, 19 nt, Artificial Sequence
  Description of Artificial Sequence: Synthetic oligonucleotide
uuacacucauuauccauuu

SEQ ID NO: 724 - RNA, 19 nt, Artificial Sequence
  Description of Artificial Sequence: Synthetic oligonucleotide
uuuggcaguguuucuguaa

SEQ ID NO: 725 - RNA, 19 nt, Artificial Sequence
  Description of Artificial Sequence: Synthetic oligonucleotide
ugguacacucauuauccau

SEQ ID NO: 726 - RNA, 19 nt, Artificial Sequence
  Description of Artificial Sequence: Synthetic oligonucleotide
uaggcaggcauaugggucg

SEQ ID NO: 727 - RNA, 19 nt, Artificial Sequence
  Description of Artificial Sequence: Synthetic oligonucleotide
uccaguuucaacaaggcaa

SEQ ID NO: 728 - RNA, 19 nt, Artificial Sequence
  Description of Artificial Sequence: Synthetic oligonucleotide
uuggccgcucccuuugagc

SEQ ID NO: 729 - RNA, 19 nt, Artificial Sequence
  Description of Artificial Sequence: Synthetic oligonucleotide
uacugugguuuccaguuuc

SEQ ID NO: 730 - RNA, 19 nt, Artificial Sequence
  Description of Artificial Sequence: Synthetic oligonucleotide
ucuuugggccauuccuggg

SEQ ID NO: 731 - RNA, 19 nt, Artificial Sequence
  Description of Artificial Sequence: Synthetic oligonucleotide
uuaagaaaaucauccugaa

SEQ ID NO: 732 - RNA, 19 nt, Artificial Sequence
  Description of Artificial Sequence: Synthetic oligonucleotide
ucucuuuuauuucagauug

SEQ ID NO: 733 - RNA, 19 nt, Artificial Sequence
  Description of Artificial Sequence: Synthetic oligonucleotide
uucuuugagauucuuuggg

SEQ ID NO: 734 - RNA, 19 nt, Artificial Sequence
  Description of Artificial Sequence: Synthetic oligonucleotide
uaaugauggagccuccaca

SEQ ID NO: 735 - RNA, 19 nt, Artificial Sequence
  Description of Artificial Sequence: Synthetic oligonucleotide
ugaagaauggcagaacacu

SEQ ID NO: 736 - RNA, 19 nt, Artificial Sequence
  Description of Artificial Sequence: Synthetic oligonucleotide
ucaaugauggagccuccac

SEQ ID NO: 737 - RNA, 19 nt, Artificial Sequence
  Description of Artificial Sequence: Synthetic oligonucleotide
uauggagccuccacacagg

SEQ ID NO: 738 - RNA, 19 nt, Artificial Sequence
  Description of Artificial Sequence: Synthetic oligonucleotide
ucccaagaaaucaguguca

SEQ ID NO: 739 - RNA, 19 nt, Artificial Sequence
  Description of Artificial Sequence: Synthetic oligonucleotide
ugagccuccacacaggugu

SEQ ID NO: 740 - RNA, 19 nt, Artificial Sequence
  Description of Artificial Sequence: Synthetic oligonucleotide
ucucccaagaaaucagugu

SEQ ID NO: 741 - RNA, 19 nt, Artificial Sequence
  Description of Artificial Sequence: Synthetic oligonucleotide
uccuccacacaggugucuc

SEQ ID NO: 742 - RNA, 19 nt, Artificial Sequence
  Description of Artificial Sequence: Synthetic oligonucleotide
uccaaugauggagccucca

SEQ ID NO: 743 - RNA, 19 nt, Artificial Sequence
  Description of Artificial Sequence: Synthetic oligonucleotide
uuuuccaaugauggagccu

SEQ ID NO: 744 - RNA, 19 nt, Artificial Sequence
  Description of Artificial Sequence: Synthetic oligonucleotide
uucccaagaaaucaguguc

SEQ ID NO: 745 - RNA, 19 nt, Artificial Sequence
  Description of Artificial Sequence: Synthetic oligonucleotide
uagccuccacacagguguc

SEQ ID NO: 746 - RNA, 19 nt, Artificial Sequence
  Description of Artificial Sequence: Synthetic oligonucleotide
uucuucucccaagaaauca

SEQ ID NO: 747 - RNA, 19 nt, Artificial Sequence
  Description of Artificial Sequence: Synthetic oligonucleotide
uguuuccaaugauggagcc

SEQ ID NO: 748 - RNA, 19 nt, Artificial Sequence
  Description of Artificial Sequence: Synthetic oligonucleotide
uuccaaugauggagccucc

SEQ ID NO: 749 - RNA, 19 nt, Artificial Sequence
  Description of Artificial Sequence: Synthetic oligonucleotide
uuggagccuccacacaggu

SEQ ID NO: 750 - RNA, 19 nt, Artificial Sequence
  Description of Artificial Sequence: Synthetic oligonucleotide
ugccuccacacaggugucu

SEQ ID NO: 751 - RNA, 15 nt, Artificial Sequence
  Description of Artificial Sequence: Synthetic oligonucleotide
caccuaagauuuuga

SEQ ID NO: 752 - RNA, 15 nt, Artificial Sequence
  Description of Artificial Sequence: Synthetic oligonucleotide
cauuuuaaaucaaua

SEQ ID NO: 753 - RNA, 15 nt, Artificial Sequence
  Description of Artificial Sequence: Synthetic oligonucleotide
cagcagcgauuucua

SEQ ID NO: 754 - RNA, 15 nt, Artificial Sequence
  Description of Artificial Sequence: Synthetic oligonucleotide
gaugauuuucuuaua

SEQ ID NO: 755 - RNA, 15 nt, Artificial Sequence
  Description of Artificial Sequence: Synthetic oligonucleotide
cuaauacgguguuua

SEQ ID NO: 756 - RNA, 15 nt, Artificial Sequence
  Description of Artificial Sequence: Synthetic oligonucleotide
caugacacugauuua

SEQ ID NO: 757 - RNA, 15 nt, Artificial Sequence
  Description of Artificial Sequence: Synthetic oligonucleotide
cagaaagcggguaua

SEQ ID NO: 758 - RNA, 15 nt, Artificial Sequence
  Description of Artificial Sequence: Synthetic oligonucleotide
uccuuaaaacaucua

SEQ ID NO: 759 - RNA, 15 nt, Artificial Sequence
  Description of Artificial Sequence: Synthetic oligonucleotide
aaagccaagauacca

SEQ ID NO: 760 - RNA, 15 nt, Artificial Sequence
  Description of Artificial Sequence: Synthetic oligonucleotide
gaagagauacagaga

SEQ ID NO: 761 - RNA, 15 nt, Artificial Sequence
  Description of Artificial Sequence: Synthetic oligonucleotide
aaauaauaauccaua

SEQ ID NO: 762 - RNA, 15 nt, Artificial Sequence
  Description of Artificial Sequence: Synthetic oligonucleotide
uuucuaaucuggcua

SEQ ID NO: 763 - RNA, 15 nt, Artificial Sequence
  Description of Artificial Sequence: Synthetic oligonucleotide
caaugccguccgcua

SEQ ID NO: 764 - RNA, 15 nt, Artificial Sequence
  Description of Artificial Sequence: Synthetic oligonucleotide
aaucaaucugaaaua

SEQ ID NO: 765 - RNA, 15 nt, Artificial Sequence
  Description of Artificial Sequence: Synthetic oligonucleotide
aaacuaagagacaaa

SEQ ID NO: 766 - RNA, 15 nt, Artificial Sequence
  Description of Artificial Sequence: Synthetic oligonucleotide
caucccaguguucua

SEQ ID NO: 767 - RNA, 15 nt, Artificial Sequence
  Description of Artificial Sequence: Synthetic oligonucleotide
cuuauaucaagugga

SEQ ID NO: 768 - RNA, 15 nt, Artificial Sequence
  Description of Artificial Sequence: Synthetic oligonucleotide
uuuguaagaaaauga

SEQ ID NO: 769 - RNA, 15 nt, Artificial Sequence
  Description of Artificial Sequence: Synthetic oligonucleotide
caguacacgcauuaa

SEQ ID NO: 770 - RNA, 15 nt, Artificial Sequence
  Description of Artificial Sequence: Synthetic oligonucleotide
aggcccucuguccua

SEQ ID NO: 771 - RNA, 15 nt, Artificial Sequence
  Description of Artificial Sequence: Synthetic oligonucleotide
caucaucccgguuga

SEQ ID NO: 772 - RNA, 15 nt, Artificial Sequence
  Description of Artificial Sequence: Synthetic oligonucleotide
aagaaaucuuuguca

SEQ ID NO: 773 - RNA, 15 nt, Artificial Sequence
  Description of Artificial Sequence: Synthetic oligonucleotide
cagcaugcuuccuca

SEQ ID NO: 774 - RNA, 15 nt, Artificial Sequence
  Description of Artificial Sequence: Synthetic oligonucleotide
uagggacauuuucca

SEQ ID NO: 775 - RNA, 15 nt, Artificial Sequence
  Description of Artificial Sequence: Synthetic oligonucleotide
caaguguuacuuaaa

SEQ ID NO: 776 - RNA, 15 nt, Artificial Sequence
  Description of Artificial Sequence: Synthetic oligonucleotide
cggguaugauauuga

SEQ ID NO: 777 - RNA, 15 nt, Artificial Sequence
  Description of Artificial Sequence: Synthetic oligonucleotide
caagugguacauuua

SEQ ID NO: 778 - RNA, 15 nt, Artificial Sequence
  Description of Artificial Sequence: Synthetic oligonucleotide
caggaugauuuucua

SEQ ID NO: 779 - RNA, 15 nt, Artificial Sequence
  Description of Artificial Sequence: Synthetic oligonucleotide
aagggcaaguguuaa

SEQ ID NO: 780 - RNA, 15 nt, Artificial Sequence
  Description of Artificial Sequence: Synthetic oligonucleotide
uguaagaaaaugcua

SEQ ID NO: 781 - RNA, 15 nt, Artificial Sequence
  Description of Artificial Sequence: Synthetic oligonucleotide
uaauacgguguuuga

SEQ ID NO: 782 - RNA, 15 nt, Artificial Sequence
  Description of Artificial Sequence: Synthetic oligonucleotide
uauuaacagccgcua

SEQ ID NO: 783 - RNA, 15 nt, Artificial Sequence
  Description of Artificial Sequence: Synthetic oligonucleotide
auuaacagccgcuca

SEQ ID NO: 784 - RNA, 15 nt, Artificial Sequence
  Description of Artificial Sequence: Synthetic oligonucleotide
gaaaucuuugucuca

SEQ ID NO: 785 - RNA, 15 nt, Artificial Sequence
  Description of Artificial Sequence: Synthetic oligonucleotide
cauaaaauaacccaa

SEQ ID NO: 786 - RNA, 15 nt, Artificial Sequence
  Description of Artificial Sequence: Synthetic oligonucleotide
cagugucauggcuca

SEQ ID NO: 787 - RNA, 15 nt, Artificial Sequence
  Description of Artificial Sequence: Synthetic oligonucleotide
cacuuucuaaucuga

SEQ ID NO: 788 - RNA, 15 nt, Artificial Sequence
  Description of Artificial Sequence: Synthetic oligonucleotide
uuucuggguauucua

SEQ ID NO: 789 - RNA, 15 nt, Artificial Sequence
  Description of Artificial Sequence: Synthetic oligonucleotide
ccuuaaaacaucuga

SEQ ID NO: 790 - RNA, 15 nt, Artificial Sequence
  Description of Artificial Sequence: Synthetic oligonucleotide
caucucuggauacaa

SEQ ID NO: 791 - RNA, 15 nt, Artificial Sequence
  Description of Artificial Sequence: Synthetic oligonucleotide
ugaaugugugacuca

SEQ ID NO: 792 - RNA, 15 nt, Artificial Sequence
  Description of Artificial Sequence: Synthetic oligonucleotide
cacaucuuucuuuga

SEQ ID NO: 793 - RNA, 15 nt, Artificial Sequence
  Description of Artificial Sequence: Synthetic oligonucleotide
uuauaucaaguggua

SEQ ID NO: 794 - RNA, 15 nt, Artificial Sequence
  Description of Artificial Sequence: Synthetic oligonucleotide
cuuaaagcuuucuua

SEQ ID NO: 795 - RNA, 15 nt, Artificial Sequence
  Description of Artificial Sequence: Synthetic oligonucleotide
ucaaucugaaauaaa

SEQ ID NO: 796 - RNA, 15 nt, Artificial Sequence
  Description of Artificial Sequence: Synthetic oligonucleotide
caaugcucacaccaa

SEQ ID NO: 797 - RNA, 15 nt, Artificial Sequence
  Description of Artificial Sequence: Synthetic oligonucleotide
cuuuucaggaugaua

SEQ ID NO: 798 - RNA, 15 nt, Artificial Sequence
  Description of Artificial Sequence: Synthetic oligonucleotide
caagcaaugcucaca

SEQ ID NO: 799 - RNA, 15 nt, Artificial Sequence
  Description of Artificial Sequence: Synthetic oligonucleotide
cagaagagauacaga

SEQ ID NO: 800 - RNA, 15 nt, Artificial Sequence
  Description of Artificial Sequence: Synthetic oligonucleotide
auacacauuaaggua

SEQ ID NO: 801 - RNA, 15 nt, Artificial Sequence
  Description of Artificial Sequence: Synthetic oligonucleotide
uaauaauccaugaua

SEQ ID NO: 802 - RNA, 15 nt, Artificial Sequence
  Description of Artificial Sequence: Synthetic oligonucleotide
caaagaaaucuuuga

SEQ ID NO: 803 - RNA, 15 nt, Artificial Sequence
  Description of Artificial Sequence: Synthetic oligonucleotide
aacuaaaauacuuca

SEQ ID NO: 804 - RNA, 15 nt, Artificial Sequence
  Description of Artificial Sequence: Synthetic oligonucleotide
uuuuaaaucaaucua

SEQ ID NO: 805 - RNA, 15 nt, Artificial Sequence
  Description of Artificial Sequence: Synthetic oligonucleotide
aagccaagauaccca

SEQ ID NO: 806 - RNA, 15 nt, Artificial Sequence
  Description of Artificial Sequence: Synthetic oligonucleotide
aaucuuugucuccua

SEQ ID NO: 807 - RNA, 15 nt, Artificial Sequence
  Description of Artificial Sequence: Synthetic oligonucleotide
cauuuuaccaugaca

SEQ ID NO: 808 - RNA, 15 nt, Artificial Sequence
  Description of Artificial Sequence: Synthetic oligonucleotide
gaagaacuggauaua

SEQ ID NO: 809 - RNA, 15 nt, Artificial Sequence
  Description of Artificial Sequence: Synthetic oligonucleotide
aagaacuggauauua

SEQ ID NO: 810 - RNA, 15 nt, Artificial Sequence
  Description of Artificial Sequence: Synthetic oligonucleotide
acuggaaaccacaga

SEQ ID NO: 811 - RNA, 15 nt, Artificial Sequence
  Description of Artificial Sequence: Synthetic oligonucleotide
gcacuuucuaaucua

SEQ ID NO: 812 - RNA, 15 nt, Artificial Sequence
  Description of Artificial Sequence: Synthetic oligonucleotide
ugacacugauuucua

SEQ ID NO: 813 - RNA, 15 nt, Artificial Sequence
  Description of Artificial Sequence: Synthetic oligonucleotide
gaaauaauaauccaa

SEQ ID NO: 814 - RNA, 15 nt, Artificial Sequence
  Description of Artificial Sequence: Synthetic oligonucleotide
acuuucuaaucugga

SEQ ID NO: 815 - RNA, 15 nt, Artificial Sequence
  Description of Artificial Sequence: Synthetic oligonucleotide
aaauggauaaugaga

SEQ ID NO: 816 - RNA, 15 nt, Artificial Sequence
  Description of Artificial Sequence: Synthetic oligonucleotide
caggaauggcccaaa

SEQ ID NO: 817 - RNA, 15 nt, Artificial Sequence
  Description of Artificial Sequence: Synthetic oligonucleotide
caaaaucaagcccaa

SEQ ID NO: 818 - RNA, 15 nt, Artificial Sequence
  Description of Artificial Sequence: Synthetic oligonucleotide
uuuaaaucaaucuga

SEQ ID NO: 819 - RNA, 15 nt, Artificial Sequence
  Description of Artificial Sequence: Synthetic oligonucleotide
caucccgguugcuua

SEQ ID NO: 820 - RNA, 15 nt, Artificial Sequence
  Description of Artificial Sequence: Synthetic oligonucleotide
ggauacacauuaaga

SEQ ID NO: 821 - RNA, 15 nt, Artificial Sequence
  Description of Artificial Sequence: Synthetic oligonucleotide
ccacagugaauuaca

SEQ ID NO: 822 - RNA, 15 nt, Artificial Sequence
  Description of Artificial Sequence: Synthetic oligonucleotide
ggagauagaaaugua

SEQ ID NO: 823 - RNA, 15 nt, Artificial Sequence
  Description of Artificial Sequence: Synthetic oligonucleotide
auuggaaaccaguga

SEQ ID NO: 824 - RNA, 15 nt, Artificial Sequence
  Description of Artificial Sequence: Synthetic oligonucleotide
aauuacacagauuca

SEQ ID NO: 825 - RNA, 15 nt, Artificial Sequence
  Description of Artificial Sequence: Synthetic oligonucleotide
agagugaauaggaca

SEQ ID NO: 826 - RNA, 15 nt, Artificial Sequence
  Description of Artificial Sequence: Synthetic oligonucleotide
uuucaagcaaugcua

SEQ ID NO: 827 - RNA, 15 nt, Artificial Sequence
  Description of Artificial Sequence: Synthetic oligonucleotide
gauuucuggguauua

SEQ ID NO: 828 - RNA, 15 nt, Artificial Sequence
  Description of Artificial Sequence: Synthetic oligonucleotide
caagaaauaauaaua

SEQ ID NO: 829 - RNA, 15 nt, Artificial Sequence
  Description of Artificial Sequence: Synthetic oligonucleotide
caacuaaaauacuua

SEQ ID NO: 830 - RNA, 15 nt, Artificial Sequence
  Description of Artificial Sequence: Synthetic oligonucleotide
cguggacuggauuca

SEQ ID NO: 831 - RNA, 15 nt, Artificial Sequence
  Description of Artificial Sequence: Synthetic oligonucleotide
agaaaucuuugucua

SEQ ID NO: 832 - RNA, 15 nt, Artificial Sequence
  Description of Artificial Sequence: Synthetic oligonucleotide
cacugaaauccugua

SEQ ID NO: 833 - RNA, 15 nt, Artificial Sequence
  Description of Artificial Sequence: Synthetic oligonucleotide
gauauugccuuguua

SEQ ID NO: 834 - RNA, 15 nt, Artificial Sequence
  Description of Artificial Sequence: Synthetic oligonucleotide
uaugauauugccuua

SEQ ID NO: 835 - RNA, 15 nt, Artificial Sequence
  Description of Artificial Sequence: Synthetic oligonucleotide
cgauuucuggguaua

SEQ ID NO: 836 - RNA, 15 nt, Artificial Sequence
  Description of Artificial Sequence: Synthetic oligonucleotide
auuuuaaaucaauca

SEQ ID NO: 837 - RNA, 15 nt, Artificial Sequence
  Description of Artificial Sequence: Synthetic oligonucleotide
caagagugaauagga

SEQ ID NO: 838 - RNA, 15 nt, Artificial Sequence
  Description of Artificial Sequence: Synthetic oligonucleotide
uuuugcgugucuaca

SEQ ID NO: 839 - RNA, 15 nt, Artificial Sequence
  Description of Artificial Sequence: Synthetic oligonucleotide
cuggagaaaacucaa

SEQ ID NO: 840 - RNA, 15 nt, Artificial Sequence
  Description of Artificial Sequence: Synthetic oligonucleotide
aaucucaaagaaaua

SEQ ID NO: 841 - RNA, 15 nt, Artificial Sequence
  Description of Artificial Sequence: Synthetic oligonucleotide
augauuuucuuauaa

SEQ ID NO: 842 - RNA, 15 nt, Artificial Sequence
  Description of Artificial Sequence: Synthetic oligonucleotide
ucaccuaagauuuua

SEQ ID NO: 843 - RNA, 15 nt, Artificial Sequence
  Description of Artificial Sequence: Synthetic oligonucleotide
cagcaucccagugua

SEQ ID NO: 844 - RNA, 15 nt, Artificial Sequence
  Description of Artificial Sequence: Synthetic oligonucleotide
ugaaauccugugcaa

SEQ ID NO: 845 - RNA, 15 nt, Artificial Sequence
  Description of Artificial Sequence: Synthetic oligonucleotide
aaucuggcuuguaua

SEQ ID NO: 846 - RNA, 15 nt, Artificial Sequence
  Description of Artificial Sequence: Synthetic oligonucleotide
aacuggaaaccacaa

SEQ ID NO: 847 - RNA, 15 nt, Artificial Sequence
  Description of Artificial Sequence: Synthetic oligonucleotide
cgaagggaagggcaa

SEQ ID NO: 848 - RNA, 15 nt, Artificial Sequence
  Description of Artificial Sequence: Synthetic oligonucleotide
uucaggaugauuuua

SEQ ID NO: 849 - RNA, 15 nt, Artificial Sequence
  Description of Artificial Sequence: Synthetic oligonucleotide
cacugauuucuugga

SEQ ID NO: 850 - RNA, 15 nt, Artificial Sequence
  Description of Artificial Sequence: Synthetic oligonucleotide
acgacccauaugcca

SEQ ID NO: 851 - RNA, 15 nt, Artificial Sequence
  Description of Artificial Sequence: Synthetic oligonucleotide
auuacacagauucua

SEQ ID NO: 852 - RNA, 15 nt, Artificial Sequence
  Description of Artificial Sequence: Synthetic oligonucleotide
uacguggacuggaua

SEQ ID NO: 853 - RNA, 15 nt, Artificial Sequence
  Description of Artificial Sequence: Synthetic oligonucleotide
aagagauacagagga

SEQ ID NO: 854 - RNA, 15 nt, Artificial Sequence
  Description of Artificial Sequence: Synthetic oligonucleotide
cugaaauccugugca

SEQ ID NO: 855 - RNA, 15 nt, Artificial Sequence
  Description of Artificial Sequence: Synthetic oligonucleotide
auucuucauuuuaca

SEQ ID NO: 856 - RNA, 15 nt, Artificial Sequence
  Description of Artificial Sequence: Synthetic oligonucleotide
agauucucaacgaca

SEQ ID NO: 857 - RNA, 15 nt, Artificial Sequence
  Description of Artificial Sequence: Synthetic oligonucleotide
cuggauauuguugca

SEQ ID NO: 858 - RNA, 15 nt, Artificial Sequence
  Description of Artificial Sequence: Synthetic oligonucleotide
aaugccguccgcuga

SEQ ID NO: 859 - RNA, 15 nt, Artificial Sequence
  Description of Artificial Sequence: Synthetic oligonucleotide
uacuuaaagcuuuca

SEQ ID NO: 860 - RNA, 15 nt, Artificial Sequence
  Description of Artificial Sequence: Synthetic oligonucleotide
uacagaaacacugca

SEQ ID NO: 861 - RNA, 15 nt, Artificial Sequence
  Description of Artificial Sequence: Synthetic oligonucleotide
uuacacagauucuca

SEQ ID NO: 862 - RNA, 15 nt, Artificial Sequence
  Description of Artificial Sequence: Synthetic oligonucleotide
guacguggacuggaa

SEQ ID NO: 863 - RNA, 15 nt, Artificial Sequence
  Description of Artificial Sequence: Synthetic oligonucleotide
aagcaaugcucacaa

SEQ ID NO: 864 - RNA, 15 nt, Artificial Sequence
  Description of Artificial Sequence: Synthetic oligonucleotide
acucaucaucccgga

SEQ ID NO: 865 - RNA, 15 nt, Artificial Sequence
  Description of Artificial Sequence: Synthetic oligonucleotide
gcucgauaaagugga

SEQ ID NO: 866 - RNA, 15 nt, Artificial Sequence
  Description of Artificial Sequence: Synthetic oligonucleotide
uaaaauggauaauga

SEQ ID NO: 867 - RNA, 15 nt, Artificial Sequence
  Description of Artificial Sequence: Synthetic oligonucleotide
ucaucaucccgguua

SEQ ID NO: 868 - RNA, 15 nt, Artificial Sequence
  Description of Artificial Sequence: Synthetic oligonucleotide
aauggcccaaagaaa

SEQ ID NO: 869 - RNA, 15 nt, Artificial Sequence
  Description of Artificial Sequence: Synthetic oligonucleotide
caagauacccuuaga

SEQ ID NO: 870 - RNA, 15 nt, Artificial Sequence
  Description of Artificial Sequence: Synthetic oligonucleotide
aaugcucacaccaaa

SEQ ID NO: 871 - RNA, 15 nt, Artificial Sequence
  Description of Artificial Sequence: Synthetic oligonucleotide
caacgacccauauga

SEQ ID NO: 872 - RNA, 15 nt, Artificial Sequence
  Description of Artificial Sequence: Synthetic oligonucleotide
uggauacacauuaaa

SEQ ID NO: 873 - RNA, 15 nt, Artificial Sequence
  Description of Artificial Sequence: Synthetic oligonucleotide
cuuaaaacaucugaa

SEQ ID NO: 874 - RNA, 15 nt, Artificial Sequence
  Description of Artificial Sequence: Synthetic oligonucleotide
cuccaucauuggaaa

SEQ ID NO: 875 - RNA, 15 nt, Artificial Sequence
  Description of Artificial Sequence: Synthetic oligonucleotide
guggacuggauucua

SEQ ID NO: 876 - RNA, 15 nt, Artificial Sequence
  Description of Artificial Sequence: Synthetic oligonucleotide
caaagaaucucaaaa

SEQ ID NO: 877 - RNA, 15 nt, Artificial Sequence
  Description of Artificial Sequence: Synthetic oligonucleotide
uuuucaggaugauua

SEQ ID NO: 878 - RNA, 15 nt, Artificial Sequence
  Description of Artificial Sequence: Synthetic oligonucleotide
gauuuugcgugucua

SEQ ID NO: 879 - RNA, 15 nt, Artificial Sequence
  Description of Artificial Sequence: Synthetic oligonucleotide
cguggucgaguacga

SEQ ID NO: 880 - RNA, 15 nt, Artificial Sequence
  Description of Artificial Sequence: Synthetic oligonucleotide
ugggugacuggauga

SEQ ID NO: 881 - RNA, 15 nt, Artificial Sequence
  Description of Artificial Sequence: Synthetic oligonucleotide
agcaucccaguguua

SEQ ID NO: 882 - RNA, 15 nt, Artificial Sequence
  Description of Artificial Sequence: Synthetic oligonucleotide
caaagcucuuucuga

SEQ ID NO: 883 - RNA, 15 nt, Artificial Sequence
  Description of Artificial Sequence: Synthetic oligonucleotide
agaaucucaaagaaa

SEQ ID NO: 884 - RNA, 15 nt, Artificial Sequence
  Description of Artificial Sequence: Synthetic oligonucleotide
uggauauuguugcua

SEQ ID NO: 885 - RNA, 15 nt, Artificial Sequence
  Description of Artificial Sequence: Synthetic oligonucleotide
cucgauaaaguggua

SEQ ID NO: 886 - RNA, 15 nt, Artificial Sequence
  Description of Artificial Sequence: Synthetic oligonucleotide
aacgaagggaaggga

SEQ ID NO: 887 - RNA, 15 nt, Artificial Sequence
  Description of Artificial Sequence: Synthetic oligonucleotide
ccuaagauuuugcga

SEQ ID NO: 888 - RNA, 15 nt, Artificial Sequence
  Description of Artificial Sequence: Synthetic oligonucleotide
cacaguaacacgcua

SEQ ID NO: 889 - RNA, 15 nt, Artificial Sequence
  Description of Artificial Sequence: Synthetic oligonucleotide
cuacagggaaggaga

SEQ ID NO: 890 - RNA, 15 nt, Artificial Sequence
  Description of Artificial Sequence: Synthetic oligonucleotide
gagauacagaggaca

SEQ ID NO: 891 - RNA, 15 nt, Artificial Sequence
  Description of Artificial Sequence: Synthetic oligonucleotide
gaaagccaagauaca

SEQ ID NO: 892 - RNA, 15 nt, Artificial Sequence
  Description of Artificial Sequence: Synthetic oligonucleotide
aacacugccaagaga

SEQ ID NO: 893 - RNA, 15 nt, Artificial Sequence
  Description of Artificial Sequence: Synthetic oligonucleotide
augacacugauuuca

SEQ ID NO: 894 - RNA, 15 nt, Artificial Sequence
  Description of Artificial Sequence: Synthetic oligonucleotide
cggcuacagggaaga

SEQ ID NO: 895 - RNA, 15 nt, Artificial Sequence
  Description of Artificial Sequence: Synthetic oligonucleotide
aagggagcggccaga

SEQ ID NO: 896 - RNA, 15 nt, Artificial Sequence
  Description of Artificial Sequence: Synthetic oligonucleotide
uaagauuuugcguga

SEQ ID NO: 897 - RNA, 15 nt, Artificial Sequence
  Description of Artificial Sequence: Synthetic oligonucleotide
cucuuucugguuuca

SEQ ID NO: 898 - RNA, 15 nt, Artificial Sequence
  Description of Artificial Sequence: Synthetic oligonucleotide
uuacuuaaagcuuua

SEQ ID NO: 899 - RNA, 15 nt, Artificial Sequence
  Description of Artificial Sequence: Synthetic oligonucleotide
cuaaucuggcuugua

SEQ ID NO: 900 - RNA, 15 nt, Artificial Sequence
  Description of Artificial Sequence: Synthetic oligonucleotide
aauggauaaugagua

SEQ ID NO: 901 - RNA, 15 nt, Artificial Sequence
  Description of Artificial Sequence: Synthetic oligonucleotide
aaggucuuuucagga

SEQ ID NO: 902 - RNA, 15 nt, Artificial Sequence
  Description of Artificial Sequence: Synthetic oligonucleotide
caucauuggaaacca

SEQ ID NO: 903 - RNA, 15 nt, Artificial Sequence
  Description of Artificial Sequence: Synthetic oligonucleotide
ccugccagaaacuga

SEQ ID NO: 904 - RNA, 15 nt, Artificial Sequence
  Description of Artificial Sequence: Synthetic oligonucleotide
caguguucugccaua

SEQ ID NO: 905 - RNA, 15 nt, Artificial Sequence
  Description of Artificial Sequence: Synthetic oligonucleotide
ucucaaagaaaucua

SEQ ID NO: 906 - RNA, 15 nt, Artificial Sequence
  Description of Artificial Sequence: Synthetic oligonucleotide
uugaaacuggaaaca

SEQ ID NO: 907 - RNA, 15 nt, Artificial Sequence
  Description of Artificial Sequence: Synthetic oligonucleotide
agagauacagaggaa

SEQ ID NO: 908 - RNA, 15 nt, Artificial Sequence
  Description of Artificial Sequence: Synthetic oligonucleotide
gucuuuucaggauga

SEQ ID NO: 909 - RNA, 15 nt, Artificial Sequence
  Description of Artificial Sequence: Synthetic oligonucleotide
uggagaaaacucaaa

SEQ ID NO: 910 - RNA, 15 nt, Artificial Sequence
  Description of Artificial Sequence: Synthetic oligonucleotide
aaccacagugaauua

SEQ ID NO: 911 - RNA, 15 nt, Artificial Sequence
  Description of Artificial Sequence: Synthetic oligonucleotide
cucaaagaaaucuua

SEQ ID NO: 912 - RNA, 15 nt, Artificial Sequence
  Description of Artificial Sequence: Synthetic oligonucleotide
aaaucuuugucucca

SEQ ID NO: 913 - RNA, 15 nt, Artificial Sequence
  Description of Artificial Sequence: Synthetic oligonucleotide
ucaggaugauuuuca

SEQ ID NO: 914 - RNA, 15 nt, Artificial Sequence
  Description of Artificial Sequence: Synthetic oligonucleotide
aaaauggcagaaaga

SEQ ID NO: 915 - RNA, 15 nt, Artificial Sequence
  Description of Artificial Sequence: Synthetic oligonucleotide
cgaguacguggacua

SEQ ID NO: 916 - RNA, 15 nt, Artificial Sequence
  Description of Artificial Sequence: Synthetic oligonucleotide
aguacacgcauuaaa

SEQ ID NO: 917 - RNA, 15 nt, Artificial Sequence
  Description of Artificial Sequence: Synthetic oligonucleotide
cuggauacacauuaa

SEQ ID NO: 918 - RNA, 15 nt, Artificial Sequence
  Description of Artificial Sequence: Synthetic oligonucleotide
uggcccaaagaauca

SEQ ID NO: 919 - RNA, 15 nt, Artificial Sequence
  Description of Artificial Sequence: Synthetic oligonucleotide
ucuuucugguuucaa

SEQ ID NO: 920 - RNA, 15 nt, Artificial Sequence
  Description of Artificial Sequence: Synthetic oligonucleotide
cuggugaauguguga

SEQ ID NO: 921 - RNA, 15 nt, Artificial Sequence
  Description of Artificial Sequence: Synthetic oligonucleotide
aaagaaaucuuugua

SEQ ID NO: 922 - RNA, 15 nt, Artificial Sequence
  Description of Artificial Sequence: Synthetic oligonucleotide
aggagauagaaauga

SEQ ID NO: 923 - RNA, 15 nt, Artificial Sequence
  Description of Artificial Sequence: Synthetic oligonucleotide
caguguuacagaaaa

SEQ ID NO: 924 - RNA, 15 nt, Artificial Sequence
  Description of Artificial Sequence: Synthetic oligonucleotide
uuucacugaaaucca

SEQ ID NO: 925 - RNA, 15 nt, Artificial Sequence
  Description of Artificial Sequence: Synthetic oligonucleotide
gcucaaagggagcga

SEQ ID NO: 926 - RNA, 15 nt, Artificial Sequence
  Description of Artificial Sequence: Synthetic oligonucleotide
gaguacguggacuga

SEQ ID NO: 927 - RNA, 15 nt, Artificial Sequence
  Description of Artificial Sequence: Synthetic oligonucleotide
cgacccauaugccua

SEQ ID NO: 928 - RNA, 15 nt, Artificial Sequence
  Description of Artificial Sequence: Synthetic oligonucleotide
gauacagaggacaua

SEQ ID NO: 929 - RNA, 15 nt, Artificial Sequence
  Description of Artificial Sequence: Synthetic oligonucleotide
caccaaaaucaagca

SEQ ID NO: 930 - RNA, 15 nt, Artificial Sequence
  Description of Artificial Sequence: Synthetic oligonucleotide
ggaggcuccaucaua

SEQ ID NO: 931 - RNA, 15 nt, Artificial Sequence
  Description of Artificial Sequence: Synthetic oligonucleotide
cagauucucaacgaa

SEQ ID NO: 932 - RNA, 15 nt, Artificial Sequence
  Description of Artificial Sequence: Synthetic oligonucleotide
uguaaaauggauaaa

SEQ ID NO: 933 - RNA, 15 nt, Artificial Sequence
  Description of Artificial Sequence: Synthetic oligonucleotide
gagugaauaggacaa

SEQ ID NO: 934 - RNA, 15 nt, Artificial Sequence
  Description of Artificial Sequence: Synthetic oligonucleotide
agaacuggauauuga

SEQ ID NO: 935 - RNA, 15 nt, Artificial Sequence
  Description of Artificial Sequence: Synthetic oligonucleotide
aaagaaucucaaaga

SEQ ID NO: 936 - RNA, 15 nt, Artificial Sequence
  Description of Artificial Sequence: Synthetic oligonucleotide
cacugccaagaguga

SEQ ID NO: 937 - RNA, 15 nt, Artificial Sequence
  Description of Artificial Sequence: Synthetic oligonucleotide
gguauucuuucaaga

SEQ ID NO: 938 - RNA, 15 nt, Artificial Sequence
  Description of Artificial Sequence: Synthetic oligonucleotide
guaugauauugccua

SEQ ID NO: 939 - RNA, 15 nt, Artificial Sequence
  Description of Artificial Sequence: Synthetic oligonucleotide
agugaauuacacaga

SEQ ID NO: 940 - RNA, 15 nt, Artificial Sequence
  Description of Artificial Sequence: Synthetic oligonucleotide
aaccaguggauauua

SEQ ID NO: 941 - RNA, 15 nt, Artificial Sequence
  Description of Artificial Sequence: Synthetic oligonucleotide
uggguauucuuucaa

SEQ ID NO: 942 - RNA, 15 nt, Artificial Sequence
  Description of Artificial Sequence: Synthetic oligonucleotide
caguggauauuaaca

SEQ ID NO: 943 - RNA, 15 nt, Artificial Sequence
  Description of Artificial Sequence: Synthetic oligonucleotide
auuuuaccaugacaa

SEQ ID NO: 944 - RNA, 15 nt, Artificial Sequence
  Description of Artificial Sequence: Synthetic oligonucleotide
auggcccaaagaaua

SEQ ID NO: 945 - RNA, 15 nt, Artificial Sequence
  Description of Artificial Sequence: Synthetic oligonucleotide
cguuggaggaacuga

SEQ ID NO: 946 - RNA, 15 nt, Artificial Sequence
  Description of Artificial Sequence: Synthetic oligonucleotide
acugaagcacaccca

SEQ ID NO: 947 - RNA, 15 nt, Artificial Sequence
  Description of Artificial Sequence: Synthetic oligonucleotide
uuaaagcuuucuuca

SEQ ID NO: 948 - RNA, 15 nt, Artificial Sequence
  Description of Artificial Sequence: Synthetic oligonucleotide
ggucuuuucaggaua

SEQ ID NO: 949 - RNA, 15 nt, Artificial Sequence
  Description of Artificial Sequence: Synthetic oligonucleotide
acuuaaagcuuucua

SEQ ID NO: 950 - RNA, 15 nt, Artificial Sequence
  Description of Artificial Sequence: Synthetic oligonucleotide
uuacagaaacacuga

SEQ ID NO: 951 - RNA, 15 nt, Artificial Sequence
  Description of Artificial Sequence: Synthetic oligonucleotide
agauuuugcguguca

SEQ ID NO: 952 - RNA, 15 nt, Artificial Sequence
  Description of Artificial Sequence: Synthetic oligonucleotide
agcaaugcucacaca

SEQ ID NO: 953 - RNA, 15 nt, Artificial Sequence
  Description of Artificial Sequence: Synthetic oligonucleotide
aagcucuuucuggua

SEQ ID NO: 954 - RNA, 15 nt, Artificial Sequence
  Description of Artificial Sequence: Synthetic oligonucleotide
ccugugcacuuucua

SEQ ID NO: 955 - RNA, 15 nt, Artificial Sequence
  Description of Artificial Sequence: Synthetic oligonucleotide
caaucugaaauaaaa

SEQ ID NO: 956 - RNA, 15 nt, Artificial Sequence
  Description of Artificial Sequence: Synthetic oligonucleotide
agaagaacuggauaa

SEQ ID NO: 957 - RNA, 15 nt, Artificial Sequence
  Description of Artificial Sequence: Synthetic oligonucleotide
cuucacuuucacgga

SEQ ID NO: 958 - RNA, 15 nt, Artificial Sequence
  Description of Artificial Sequence: Synthetic oligonucleotide
uacugaagcacacca

SEQ ID NO: 959 - RNA, 15 nt, Artificial Sequence
  Description of Artificial Sequence: Synthetic oligonucleotide
gaggcccucugucca

SEQ ID NO: 960 - RNA, 15 nt, Artificial Sequence
  Description of Artificial Sequence: Synthetic oligonucleotide
aggaugauuuucuua

SEQ ID NO: 961 - RNA, 15 nt, Artificial Sequence
  Description of Artificial Sequence: Synthetic oligonucleotide
cccaaagaaucucaa

SEQ ID NO: 962 - RNA, 15 nt, Artificial Sequence
  Description of Artificial Sequence: Synthetic oligonucleotide
ucuccuuaaaacaua

SEQ ID NO: 963 - RNA, 15 nt, Artificial Sequence
  Description of Artificial Sequence: Synthetic oligonucleotide
ugccagaaacuguga

SEQ ID NO: 964 - RNA, 15 nt, Artificial Sequence
  Description of Artificial Sequence: Synthetic oligonucleotide
gaacuggauauugua

SEQ ID NO: 965 - RNA, 15 nt, Artificial Sequence
  Description of Artificial Sequence: Synthetic oligonucleotide
uuucuggugaaugua

SEQ ID NO: 966 - RNA, 15 nt, Artificial Sequence
  Description of Artificial Sequence: Synthetic oligonucleotide
augauauugccuuga

SEQ ID NO: 967 - RNA, 15 nt, Artificial Sequence
  Description of Artificial Sequence: Synthetic oligonucleotide
caggaucguuggaga

SEQ ID NO: 968 - RNA, 15 nt, Artificial Sequence
  Description of Artificial Sequence: Synthetic oligonucleotide
cuuucugguuucaga

SEQ ID NO: 969 - RNA, 15 nt, Artificial Sequence
  Description of Artificial Sequence: Synthetic oligonucleotide
uugcaagggagauua

SEQ ID NO: 970 - RNA, 15 nt, Artificial Sequence
  Description of Artificial Sequence: Synthetic oligonucleotide
cagugaauuacacaa

SEQ ID NO: 971 - RNA, 15 nt, Artificial Sequence
  Description of Artificial Sequence: Synthetic oligonucleotide
gauuuucacugaaaa

SEQ ID NO: 972 - RNA, 15 nt, Artificial Sequence
  Description of Artificial Sequence: Synthetic oligonucleotide
uuucaggaugauuua

SEQ ID NO: 973 - RNA, 15 nt, Artificial Sequence
  Description of Artificial Sequence: Synthetic oligonucleotide
ggauaaugaguguaa

SEQ ID NO: 974 - RNA, 15 nt, Artificial Sequence
  Description of Artificial Sequence: Synthetic oligonucleotide
agaaacacugccaaa

SEQ ID NO: 975 - RNA, 15 nt, Artificial Sequence
  Description of Artificial Sequence: Synthetic oligonucleotide
auaaugaguguacca

SEQ ID NO: 976 - RNA, 15 nt, Artificial Sequence
  Description of Artificial Sequence: Synthetic oligonucleotide
ccauaugccugccua

SEQ ID NO: 977 - RNA, 15 nt, Artificial Sequence
  Description of Artificial Sequence: Synthetic oligonucleotide
cuuguugaaacugga

SEQ ID NO: 978 - RNA, 15 nt, Artificial Sequence
  Description of Artificial Sequence: Synthetic oligonucleotide
aaagggagcggccaa

SEQ ID NO: 979 - RNA, 15 nt, Artificial Sequence
  Description of Artificial Sequence: Synthetic oligonucleotide
cuggaaaccacagua

SEQ ID NO: 980 - RNA, 15 nt, Artificial Sequence
  Description of Artificial Sequence: Synthetic oligonucleotide
ggaauggcccaaaga

SEQ ID NO: 981 - RNA, 15 nt, Artificial Sequence
  Description of Artificial Sequence: Synthetic oligonucleotide
ggaugauuuucuuaa

SEQ ID NO: 982 - RNA, 15 nt, Artificial Sequence
  Description of Artificial Sequence: Synthetic oligonucleotide
cugaaauaaaagaga

SEQ ID NO: 983 - RNA, 15 nt, Artificial Sequence
  Description of Artificial Sequence: Synthetic oligonucleotide
aagaaucucaaagaa

SEQ ID NO: 984 - RNA, 15 nt, Artificial Sequence
  Description of Artificial Sequence: Synthetic oligonucleotide
gaggcuccaucauua

SEQ ID NO: 985 - RNA, 15 nt, Artificial Sequence
  Description of Artificial Sequence: Synthetic oligonucleotide
uucugccauucuuca

SEQ ID NO: 986 - RNA, 15 nt, Artificial Sequence
  Description of Artificial Sequence: Synthetic oligonucleotide
aggcuccaucauuga

SEQ ID NO: 987 - RNA, 15 nt, Artificial Sequence
  Description of Artificial Sequence: Synthetic oligonucleotide
uguggaggcuccaua

SEQ ID NO: 988 - RNA, 15 nt, Artificial Sequence
  Description of Artificial Sequence: Synthetic oligonucleotide
acugauuucuuggga

SEQ ID NO: 989 - RNA, 15 nt, Artificial Sequence
  Description of Artificial Sequence: Synthetic oligonucleotide
cuguguggaggcuca

SEQ ID NO: 990 - RNA, 15 nt, Artificial Sequence
  Description of Artificial Sequence: Synthetic oligonucleotide
ugauuucuugggaga

SEQ ID NO: 991 - RNA, 15 nt, Artificial Sequence
  Description of Artificial Sequence: Synthetic oligonucleotide
caccuguguggagga

SEQ ID NO: 992 - RNA, 15 nt, Artificial Sequence
  Description of Artificial Sequence: Synthetic oligonucleotide
ggcuccaucauugga

SEQ ID NO: 993 - RNA, 15 nt, Artificial Sequence
  Description of Artificial Sequence: Synthetic oligonucleotide
uccaucauuggaaaa

SEQ ID NO: 994 - RNA, 15 nt, Artificial Sequence
  Description of Artificial Sequence: Synthetic oligonucleotide
cugauuucuugggaa

SEQ ID NO: 995 - RNA, 15 nt, Artificial Sequence
  Description of Artificial Sequence: Synthetic oligonucleotide
ccuguguggaggcua

SEQ ID NO: 996 - RNA, 15 nt, Artificial Sequence
  Description of Artificial Sequence: Synthetic oligonucleotide
uucuugggagaagaa

SEQ ID NO: 997 - RNA, 15 nt, Artificial Sequence
  Description of Artificial Sequence: Synthetic oligonucleotide
ccaucauuggaaaca

SEQ ID NO: 998 - RNA, 15 nt, Artificial Sequence
  Description of Artificial Sequence: Synthetic oligonucleotide
gcuccaucauuggaa

SEQ ID NO: 999 - RNA, 15 nt, Artificial Sequence
  Description of Artificial Sequence: Synthetic oligonucleotide
guguggaggcuccaa

SEQ ID NO: 1000 - RNA, 15 nt, Artificial Sequence
  Description of Artificial Sequence: Synthetic oligonucleotide
accuguguggaggca

SEQ ID NO: 1001 - RNA, 19 nt, Artificial Sequence
  Description of Artificial Sequence: Synthetic oligonucleotide
gagucaccuaagauuuugc

SEQ ID NO: 1002 - RNA, 19 nt, Artificial Sequence
  Description of Artificial Sequence: Synthetic oligonucleotide
guggcauuuuaaaucaauc

SEQ ID NO: 1003 - RNA, 19 nt, Artificial Sequence
  Description of Artificial Sequence: Synthetic oligonucleotide
aggacagcagcgauuucug

SEQ ID NO: 1004 - RNA, 19 nt, Artificial Sequence
  Description of Artificial Sequence: Synthetic oligonucleotide
ucaggaugauuuucuuaua

SEQ ID NO: 1005 - RNA, 19 nt, Artificial Sequence
  Description of Artificial Sequence: Synthetic oligonucleotide
uucccuaauacgguguuug

SEQ ID NO: 1006 - RNA, 19 nt, Artificial Sequence
  Description of Artificial Sequence: Synthetic oligonucleotide
uuaccaugacacugauuuc

SEQ ID NO: 1007 - RNA, 19 nt, Artificial Sequence
  Description of Artificial Sequence: Synthetic oligonucleotide
auggcagaaagcggguaug

SEQ ID NO: 1008 - RNA, 19 nt, Artificial Sequence
  Description of Artificial Sequence: Synthetic oligonucleotide
ugucuccuuaaaacaucug

SEQ ID NO: 1009 - RNA, 19 nt, Artificial Sequence
  Description of Artificial Sequence: Synthetic oligonucleotide
ccagaaagccaagauaccc

SEQ ID NO: 1010 - RNA, 19 nt, Artificial Sequence
  Description of Artificial Sequence: Synthetic oligonucleotide
gccagaagagauacagagg

SEQ ID NO: 1011 - RNA, 19 nt, Artificial Sequence
  Description of Artificial Sequence: Synthetic oligonucleotide
caagaaauaauaauccaug

SEQ ID NO: 1012 - RNA, 19 nt, Artificial Sequence
  Description of Artificial Sequence: Synthetic oligonucleotide
gcacuuucuaaucuggcuu

SEQ ID NO: 1013 - RNA, 19 nt, Artificial Sequence
  Description of Artificial Sequence: Synthetic oligonucleotide
gcaccaaugccguccgcug

SEQ ID NO: 1014 - RNA, 19 nt, Artificial Sequence
  Description of Artificial Sequence: Synthetic oligonucleotide
uuuaaaucaaucugaaaua

SEQ ID NO: 1015 - RNA, 19 nt, Artificial Sequence
  Description of Artificial Sequence: Synthetic oligonucleotide
cagaaaacuaagagacaaa

SEQ ID NO: 1016 - RNA, 19 nt, Artificial Sequence
  Description of Artificial Sequence: Synthetic oligonucleotide
acagcaucccaguguucug

SEQ ID NO: 1017 - RNA, 19 nt, Artificial Sequence
  Description of Artificial Sequence: Synthetic oligonucleotide
uuuucuuauaucaaguggu

SEQ ID NO: 1018 - RNA, 19 nt, Artificial Sequence
  Description of Artificial Sequence: Synthetic oligonucleotide
gguguuuguaagaaaaugc

SEQ ID NO: 1019 - RNA, 19 nt, Artificial Sequence
  Description of Artificial Sequence: Synthetic oligonucleotide
ugcccaguacacgcauuaa

SEQ ID NO: 1020 - RNA, 19 nt, Artificial Sequence
  Description of Artificial Sequence: Synthetic oligonucleotide
cgggaggcccucuguccug

SEQ ID NO: 1021 - RNA, 19 nt, Artificial Sequence
  Description of Artificial Sequence: Synthetic oligonucleotide
cacucaucaucccgguugc

SEQ ID NO: 1022 - RNA, 19 nt, Artificial Sequence
  Description of Artificial Sequence: Synthetic oligonucleotide
cucaaagaaaucuuugucu

SEQ ID NO: 1023 - RNA, 19 nt, Artificial Sequence
  Description of Artificial Sequence: Synthetic oligonucleotide
gugccagcaugcuuccucc

SEQ ID NO: 1024 - RNA, 19 nt, Artificial Sequence
  Description of Artificial Sequence: Synthetic oligonucleotide
guauuagggacauuuuccc

SEQ ID NO: 1025 - RNA, 19 nt, Artificial Sequence
  Description of Artificial Sequence: Synthetic oligonucleotide
agggcaaguguuacuuaaa

SEQ ID NO: 1026 - RNA, 19 nt, Artificial Sequence
  Description of Artificial Sequence: Synthetic oligonucleotide
aaagcggguaugauauugc

SEQ ID NO: 1027 - RNA, 19 nt, Artificial Sequence
  Description of Artificial Sequence: Synthetic oligonucleotide
auaucaagugguacauuuc

SEQ ID NO: 1028 - RNA, 19 nt, Artificial Sequence
  Description of Artificial Sequence: Synthetic oligonucleotide
uuuucaggaugauuuucuu

SEQ ID NO: 1029 - RNA, 19 nt, Artificial Sequence
  Description of Artificial Sequence: Synthetic oligonucleotide
agggaagggcaaguguuac

SEQ ID NO: 1030 - RNA, 19 nt, Artificial Sequence
  Description of Artificial Sequence: Synthetic oligonucleotide
uguuuguaagaaaaugcua

SEQ ID NO: 1031 - RNA, 19 nt, Artificial Sequence
  Description of Artificial Sequence: Synthetic oligonucleotide
ucccuaauacgguguuugc

SEQ ID NO: 1032 - RNA, 19 nt, Artificial Sequence
  Description of Artificial Sequence: Synthetic oligonucleotide
uggauauuaacagccgcuc

SEQ ID NO: 1033 - RNA, 19 nt, Artificial Sequence
  Description of Artificial Sequence: Synthetic oligonucleotide
ggauauuaacagccgcuca

SEQ ID NO: 1034 - RNA, 19 nt, Artificial Sequence
  Description of Artificial Sequence: Synthetic oligonucleotide
caaagaaaucuuugucucc

SEQ ID NO: 1035 - RNA, 19 nt, Artificial Sequence
  Description of Artificial Sequence: Synthetic oligonucleotide
aggacauaaaauaacccau

SEQ ID NO: 1036 - RNA, 19 nt, Artificial Sequence
  Description of Artificial Sequence: Synthetic oligonucleotide
ucgacagugucauggcucc

SEQ ID NO: 1037 - RNA, 19 nt, Artificial Sequence
  Description of Artificial Sequence: Synthetic oligonucleotide
ugugcacuuucuaaucugg

SEQ ID NO: 1038 - RNA, 19 nt, Artificial Sequence
  Description of Artificial Sequence: Synthetic oligonucleotide
gcgauuucuggguauucuu

SEQ ID NO: 1039 - RNA, 19 nt, Artificial Sequence
  Description of Artificial Sequence: Synthetic oligonucleotide
gucuccuuaaaacaucuga

SEQ ID NO: 1040 - RNA, 19 nt, Artificial Sequence
  Description of Artificial Sequence: Synthetic oligonucleotide
gaggcaucucuggauacac

SEQ ID NO: 1041 - RNA, 19 nt, Artificial Sequence
  Description of Artificial Sequence: Synthetic oligonucleotide
cuggugaaugugugacuca

SEQ ID NO: 1042 - RNA, 19 nt, Artificial Sequence
  Description of Artificial Sequence: Synthetic oligonucleotide
aggacacaucuuucuuugg

SEQ ID NO: 1043 - RNA, 19 nt, Artificial Sequence
  Description of Artificial Sequence: Synthetic oligonucleotide
uuucuuauaucaaguggua

SEQ ID NO: 1044 - RNA, 19 nt, Artificial Sequence
  Description of Artificial Sequence: Synthetic oligonucleotide
guuacuuaaagcuuucuuc

SEQ ID NO: 1045 - RNA, 19 nt, Artificial Sequence
  Description of Artificial Sequence: Synthetic oligonucleotide
uaaaucaaucugaaauaaa

SEQ ID NO: 1046 - RNA, 19 nt, Artificial Sequence
  Description of Artificial Sequence: Synthetic oligonucleotide
caagcaaugcucacaccaa

SEQ ID NO: 1047 - RNA, 19 nt, Artificial Sequence
  Description of Artificial Sequence: Synthetic oligonucleotide
aggucuuuucaggaugauu

SEQ ID NO: 1048 - RNA, 19 nt, Artificial Sequence
  Description of Artificial Sequence: Synthetic oligonucleotide
cuuucaagcaaugcucaca

SEQ ID NO: 1049 - RNA, 19 nt, Artificial Sequence
  Description of Artificial Sequence: Synthetic oligonucleotide
gugccagaagagauacaga

SEQ ID NO: 1050 - RNA, 19 nt, Artificial Sequence
  Description of Artificial Sequence: Synthetic oligonucleotide
cuggauacacauuaagguu

SEQ ID NO: 1051 - RNA, 19 nt, Artificial Sequence
  Description of Artificial Sequence: Synthetic oligonucleotide
gaaauaauaauccaugauc

SEQ ID NO: 1052 - RNA, 19 nt, Artificial Sequence
  Description of Artificial Sequence: Synthetic oligonucleotide
aucucaaagaaaucuuugu

SEQ ID NO: 1053 - RNA, 19 nt, Artificial Sequence
  Description of Artificial Sequence: Synthetic oligonucleotide
cuccaacuaaaauacuuca

SEQ ID NO: 1054 - RNA, 19 nt, Artificial Sequence
  Description of Artificial Sequence: Synthetic oligonucleotide
ggcauuuuaaaucaaucug

SEQ ID NO: 1055 - RNA, 19 nt, Artificial Sequence
  Description of Artificial Sequence: Synthetic oligonucleotide
cagaaagccaagauacccu

SEQ ID NO: 1056 - RNA, 19 nt, Artificial Sequence
  Description of Artificial Sequence: Synthetic oligonucleotide
aagaaaucuuugucuccuu

SEQ ID NO: 1057 - RNA, 19 nt, Artificial Sequence
  Description of Artificial Sequence: Synthetic oligonucleotide
ucuucauuuuaccaugaca

SEQ ID NO: 1058 - RNA, 19 nt, Artificial Sequence
  Description of Artificial Sequence: Synthetic oligonucleotide
gggagaagaacuggauauu

SEQ ID NO: 1059 - RNA, 19 nt, Artificial Sequence
  Description of Artificial Sequence: Synthetic oligonucleotide
ggagaagaacuggauauug

SEQ ID NO: 1060 - RNA, 19 nt, Artificial Sequence
  Description of Artificial Sequence: Synthetic oligonucleotide
ugaaacuggaaaccacagu

SEQ ID NO: 1061 - RNA, 19 nt, Artificial Sequence
  Description of Artificial Sequence: Synthetic oligonucleotide
cugugcacuuucuaaucug

SEQ ID NO: 1062 - RNA, 19 nt, Artificial Sequence
  Description of Artificial Sequence: Synthetic oligonucleotide
accaugacacugauuucuu

SEQ ID NO: 1063 - RNA, 19 nt, Artificial Sequence
  Description of Artificial Sequence: Synthetic oligonucleotide
ucaagaaauaauaauccau

SEQ ID NO: 1064 - RNA, 19 nt, Artificial Sequence
  Description of Artificial Sequence: Synthetic oligonucleotide
gugcacuuucuaaucuggc

SEQ ID NO: 1065 - RNA, 19 nt, Artificial Sequence
  Description of Artificial Sequence: Synthetic oligonucleotide
uguaaaauggauaaugagu

SEQ ID NO: 1066 - RNA, 19 nt, Artificial Sequence
  Description of Artificial Sequence: Synthetic oligonucleotide
uucccaggaauggcccaaa

SEQ ID NO: 1067 - RNA, 19 nt, Artificial Sequence
  Description of Artificial Sequence: Synthetic oligonucleotide
ccaccaaaaucaagcccag

SEQ ID NO: 1068 - RNA, 19 nt, Artificial Sequence
  Description of Artificial Sequence: Synthetic oligonucleotide
gcauuuuaaaucaaucuga

SEQ ID NO: 1069 - RNA, 19 nt, Artificial Sequence
  Description of Artificial Sequence: Synthetic oligonucleotide
ucaucaucccgguugcuug

SEQ ID NO: 1070 - RNA, 19 nt, Artificial Sequence
  Description of Artificial Sequence: Synthetic oligonucleotide
cucuggauacacauuaagg

SEQ ID NO: 1071 - RNA, 19 nt, Artificial Sequence
  Description of Artificial Sequence: Synthetic oligonucleotide
gaaaccacagugaauuaca

SEQ ID NO: 1072 - RNA, 19 nt, Artificial Sequence
  Description of Artificial Sequence: Synthetic oligonucleotide
caaaggagauagaaaugua

SEQ ID NO: 1073 - RNA, 19 nt, Artificial Sequence
  Description of Artificial Sequence: Synthetic oligonucleotide
caucauuggaaaccagugg

SEQ ID NO: 1074 - RNA, 19 nt, Artificial Sequence
  Description of Artificial Sequence: Synthetic oligonucleotide
agugaauuacacagauucu

SEQ ID NO: 1075 - RNA, 19 nt, Artificial Sequence
  Description of Artificial Sequence: Synthetic oligonucleotide
gccaagagugaauaggaca

SEQ ID NO: 1076 - RNA, 19 nt, Artificial Sequence
  Description of Artificial Sequence: Synthetic oligonucleotide
auucuuucaagcaaugcuc

SEQ ID NO: 1077 - RNA, 19 nt, Artificial Sequence
  Description of Artificial Sequence: Synthetic oligonucleotide
cagcgauuucuggguauuc

SEQ ID NO: 1078 - RNA, 19 nt, Artificial Sequence
  Description of Artificial Sequence: Synthetic oligonucleotide
gguucaagaaauaauaauc

SEQ ID NO: 1079 - RNA, 19 nt, Artificial Sequence
  Description of Artificial Sequence: Synthetic oligonucleotide
ucuccaacuaaaauacuuc

SEQ ID NO: 1080 - RNA, 19 nt, Artificial Sequence
  Description of Artificial Sequence: Synthetic oligonucleotide
aguacguggacuggauucu

SEQ ID NO: 1081 - RNA, 19 nt, Artificial Sequence
  Description of Artificial Sequence: Synthetic oligonucleotide
ucaaagaaaucuuugucuc

SEQ ID NO: 1082 - RNA, 19 nt, Artificial Sequence
  Description of Artificial Sequence: Synthetic oligonucleotide
uuuucacugaaauccugug

SEQ ID NO: 1083 - RNA, 19 nt, Artificial Sequence
  Description of Artificial Sequence: Synthetic oligonucleotide
guaugauauugccuuguug

SEQ ID NO: 1084 - RNA, 19 nt, Artificial Sequence
  Description of Artificial Sequence: Synthetic oligonucleotide
cggguaugauauugccuug

SEQ ID NO: 1085 - RNA, 19 nt, Artificial Sequence
  Description of Artificial Sequence: Synthetic oligonucleotide
gcagcgauuucuggguauu

SEQ ID NO: 1086 - RNA, 19 nt, Artificial Sequence
  Description of Artificial Sequence: Synthetic oligonucleotide
uggcauuuuaaaucaaucu

SEQ ID NO: 1087 - RNA, 19 nt, Artificial Sequence
  Description of Artificial Sequence: Synthetic oligonucleotide
cugccaagagugaauagga

SEQ ID NO: 1088 - RNA, 19 nt, Artificial Sequence
  Description of Artificial Sequence: Synthetic oligonucleotide
aagauuuugcgugucuaca

SEQ ID NO: 1089 - RNA, 19 nt, Artificial Sequence
  Description of Artificial Sequence: Synthetic oligonucleotide
gauucuggagaaaacucaa

SEQ ID NO: 1090 - RNA, 19 nt, Artificial Sequence
  Description of Artificial Sequence: Synthetic oligonucleotide
aaagaaucucaaagaaauc

SEQ ID NO: 1091 - RNA, 19 nt, Artificial Sequence
  Description of Artificial Sequence: Synthetic oligonucleotide
caggaugauuuucuuauau

SEQ ID NO: 1092 - RNA, 19 nt, Artificial Sequence
  Description of Artificial Sequence: Synthetic oligonucleotide
agagucaccuaagauuuug

SEQ ID NO: 1093 - RNA, 19 nt, Artificial Sequence
  Description of Artificial Sequence: Synthetic oligonucleotide
ggcacagcaucccaguguu

SEQ ID NO: 1094 - RNA, 19 nt, Artificial Sequence
  Description of Artificial Sequence: Synthetic oligonucleotide
ucacugaaauccugugcac

SEQ ID NO: 1095 - RNA, 19 nt, Artificial Sequence
  Description of Artificial Sequence: Synthetic oligonucleotide
uucuaaucuggcuuguauu

SEQ ID NO: 1096 - RNA, 19 nt, Artificial Sequence
  Description of Artificial Sequence: Synthetic oligonucleotide
uugaaacuggaaaccacag

SEQ ID NO: 1097 - RNA, 19 nt, Artificial Sequence
  Description of Artificial Sequence: Synthetic oligonucleotide
gcaacgaagggaagggcaa

SEQ ID NO: 1098 - RNA, 19 nt, Artificial Sequence
  Description of Artificial Sequence: Synthetic oligonucleotide
ucuuuucaggaugauuuuc

SEQ ID NO: 1099 - RNA, 19 nt, Artificial Sequence
  Description of Artificial Sequence: Synthetic oligonucleotide
augacacugauuucuuggg

SEQ ID NO: 1100 - RNA, 19 nt, Artificial Sequence
  Description of Artificial Sequence: Synthetic oligonucleotide
cucaacgacccauaugccu

SEQ ID NO: 1101 - RNA, 19 nt, Artificial Sequence
  Description of Artificial Sequence: Synthetic oligonucleotide
gugaauuacacagauucuc

SEQ ID NO: 1102 - RNA, 19 nt, Artificial Sequence
  Description of Artificial Sequence: Synthetic oligonucleotide
cgaguacguggacuggauu

SEQ ID NO: 1103 - RNA, 19 nt, Artificial Sequence
  Description of Artificial Sequence: Synthetic oligonucleotide
ccagaagagauacagagga

SEQ ID NO: 1104 - RNA, 19 nt, Artificial Sequence
  Description of Artificial Sequence: Synthetic oligonucleotide
uucacugaaauccugugca

SEQ ID NO: 1105 - RNA, 19 nt, Artificial Sequence
  Description of Artificial Sequence: Synthetic oligonucleotide
ugccauucuucauuuuacc

SEQ ID NO: 1106 - RNA, 19 nt, Artificial Sequence
  Description of Artificial Sequence: Synthetic oligonucleotide
acacagauucucaacgacc

SEQ ID NO: 1107 - RNA, 19 nt, Artificial Sequence
  Description of Artificial Sequence: Synthetic oligonucleotide
agaacuggauauuguugcu

SEQ ID NO: 1108 - RNA, 19 nt, Artificial Sequence
  Description of Artificial Sequence: Synthetic oligonucleotide
caccaaugccguccgcugc

SEQ ID NO: 1109 - RNA, 19 nt, Artificial Sequence
  Description of Artificial Sequence: Synthetic oligonucleotide
guguuacuuaaagcuuucu

SEQ ID NO: 1110 - RNA, 19 nt, Artificial Sequence
  Description of Artificial Sequence: Synthetic oligonucleotide
guguuacagaaacacugcc

SEQ ID NO: 1111 - RNA, 19 nt, Artificial Sequence
  Description of Artificial Sequence: Synthetic oligonucleotide
ugaauuacacagauucuca

SEQ ID NO: 1112 - RNA, 19 nt, Artificial Sequence
  Description of Artificial Sequence: Synthetic oligonucleotide
ucgaguacguggacuggau

SEQ ID NO: 1113 - RNA, 19 nt, Artificial Sequence
  Description of Artificial Sequence: Synthetic oligonucleotide
uuucaagcaaugcucacac

SEQ ID NO: 1114 - RNA, 19 nt, Artificial Sequence
  Description of Artificial Sequence: Synthetic oligonucleotide
cugcacucaucaucccggu

SEQ ID NO: 1115 - RNA, 19 nt, Artificial Sequence
  Description of Artificial Sequence: Synthetic oligonucleotide
cgaagcucgauaaaguggu

SEQ ID NO: 1116 - RNA, 19 nt, Artificial Sequence
  Description of Artificial Sequence: Synthetic oligonucleotide
uguguaaaauggauaauga

SEQ ID NO: 1117 - RNA, 19 nt, Artificial Sequence
  Description of Artificial Sequence: Synthetic oligonucleotide
gcacucaucaucccgguug

SEQ ID NO: 1118 - RNA, 19 nt, Artificial Sequence
  Description of Artificial Sequence: Synthetic oligonucleotide
caggaauggcccaaagaau

SEQ ID NO: 1119 - RNA, 19 nt, Artificial Sequence
  Description of Artificial Sequence: Synthetic oligonucleotide
aagccaagauacccuuagu

SEQ ID NO: 1120 - RNA, 19 nt, Artificial Sequence
  Description of Artificial Sequence: Synthetic oligonucleotide
aagcaaugcucacaccaaa

SEQ ID NO: 1121 - RNA, 19 nt, Artificial Sequence
  Description of Artificial Sequence: Synthetic oligonucleotide
uucucaacgacccauaugc

SEQ ID NO: 1122 - RNA, 19 nt, Artificial Sequence
  Description of Artificial Sequence: Synthetic oligonucleotide
ucucuggauacacauuaag

SEQ ID NO: 1123 - RNA, 19 nt, Artificial Sequence
  Description of Artificial Sequence: Synthetic oligonucleotide
ucuccuuaaaacaucugag

SEQ ID NO: 1124 - RNA, 19 nt, Artificial Sequence
  Description of Artificial Sequence: Synthetic oligonucleotide
gaggcuccaucauuggaaa

SEQ ID NO: 1125 - RNA, 19 nt, Artificial Sequence
  Description of Artificial Sequence: Synthetic oligonucleotide
guacguggacuggauucug

SEQ ID NO: 1126 - RNA, 19 nt, Artificial Sequence
  Description of Artificial Sequence: Synthetic oligonucleotide
ggcccaaagaaucucaaag

SEQ ID NO: 1127 - RNA, 19 nt, Artificial Sequence
  Description of Artificial Sequence: Synthetic oligonucleotide
ggucuuuucaggaugauuu

SEQ ID NO: 1128 - RNA, 19 nt, Artificial Sequence
  Description of Artificial Sequence: Synthetic oligonucleotide
cuaagauuuugcgugucua

SEQ ID NO: 1129 - RNA, 19 nt, Artificial Sequence
  Description of Artificial Sequence: Synthetic oligonucleotide
ccaacguggucgaguacgu

SEQ ID NO: 1130 - RNA, 19 nt, Artificial Sequence
  Description of Artificial Sequence: Synthetic oligonucleotide
uugcugggugacuggaugg

SEQ ID NO: 1131 - RNA, 19 nt, Artificial Sequence
  Description of Artificial Sequence: Synthetic oligonucleotide
gcacagcaucccaguguuc

SEQ ID NO: 1132 - RNA, 19 nt, Artificial Sequence
  Description of Artificial Sequence: Synthetic oligonucleotide
agagcaaagcucuuucugg

SEQ ID NO: 1133 - RNA, 19 nt, Artificial Sequence
  Description of Artificial Sequence: Synthetic oligonucleotide
ccaaagaaucucaaagaaa

SEQ ID NO: 1134 - RNA, 19 nt, Artificial Sequence
  Description of Artificial Sequence: Synthetic oligonucleotide
gaacuggauauuguugcug

SEQ ID NO: 1135 - RNA, 19 nt, Artificial Sequence
  Description of Artificial Sequence: Synthetic oligonucleotide
gaagcucgauaaaguggug

SEQ ID NO: 1136 - RNA, 19 nt, Artificial Sequence
  Description of Artificial Sequence: Synthetic oligonucleotide
cugcaacgaagggaagggc

SEQ ID NO: 1137 - RNA, 19 nt, Artificial Sequence
  Description of Artificial Sequence: Synthetic oligonucleotide
gucaccuaagauuuugcgu

SEQ ID NO: 1138 - RNA, 19 nt, Artificial Sequence
  Description of Artificial Sequence: Synthetic oligonucleotide
ccuccacaguaacacgcug

SEQ ID NO: 1139 - RNA, 19 nt, Artificial Sequence
  Description of Artificial Sequence: Synthetic oligonucleotide
ccggcuacagggaaggagg

SEQ ID NO: 1140 - RNA, 19 nt, Artificial Sequence
  Description of Artificial Sequence: Synthetic oligonucleotide
agaagagauacagaggaca

SEQ ID NO: 1141 - RNA, 19 nt, Artificial Sequence
  Description of Artificial Sequence: Synthetic oligonucleotide
uccagaaagccaagauacc

SEQ ID NO: 1142 - RNA, 19 nt, Artificial Sequence
  Description of Artificial Sequence: Synthetic oligonucleotide
cagaaacacugccaagagu

SEQ ID NO: 1143 - RNA, 19 nt, Artificial Sequence
  Description of Artificial Sequence: Synthetic oligonucleotide
uaccaugacacugauuucu

SEQ ID NO: 1144 - RNA, 19 nt, Artificial Sequence
  Description of Artificial Sequence: Synthetic oligonucleotide
gugccggcuacagggaagg

SEQ ID NO: 1145 - RNA, 19 nt, Artificial Sequence
  Description of Artificial Sequence: Synthetic oligonucleotide
cucaaagggagcggccagg

SEQ ID NO: 1146 - RNA, 19 nt, Artificial Sequence
  Description of Artificial Sequence: Synthetic oligonucleotide
caccuaagauuuugcgugu

SEQ ID NO: 1147 - RNA, 19 nt, Artificial Sequence
  Description of Artificial Sequence: Synthetic oligonucleotide
aaagcucuuucugguuuca

SEQ ID NO: 1148 - RNA, 19 nt, Artificial Sequence
  Description of Artificial Sequence: Synthetic oligonucleotide
aguguuacuuaaagcuuuc

SEQ ID NO: 1149 - RNA, 19 nt, Artificial Sequence
  Description of Artificial Sequence: Synthetic oligonucleotide
cuuucuaaucuggcuugua

SEQ ID NO: 1150 - RNA, 19 nt, Artificial Sequence
  Description of Artificial Sequence: Synthetic oligonucleotide
guaaaauggauaaugagug

SEQ ID NO: 1151 - RNA, 19 nt, Artificial Sequence
  Description of Artificial Sequence: Synthetic oligonucleotide
caacaaggucuuuucagga

SEQ ID NO: 1152 - RNA, 19 nt, Artificial Sequence
  Description of Artificial Sequence: Synthetic oligonucleotide
gcuccaucauuggaaacca

SEQ ID NO: 1153 - RNA, 19 nt, Artificial Sequence
  Description of Artificial Sequence: Synthetic oligonucleotide
gaggccugccagaaacugu

SEQ ID NO: 1154 - RNA, 19 nt, Artificial Sequence
  Description of Artificial Sequence: Synthetic oligonucleotide
aucccaguguucugccauu

SEQ ID NO: 1155 - RNA, 19 nt, Artificial Sequence
  Description of Artificial Sequence: Synthetic oligonucleotide
agaaucucaaagaaaucuu

SEQ ID NO: 1156 - RNA, 19 nt, Artificial Sequence
  Description of Artificial Sequence: Synthetic oligonucleotide
cuuguugaaacuggaaacc

SEQ ID NO: 1157 - RNA, 19 nt, Artificial Sequence
  Description of Artificial Sequence: Synthetic oligonucleotide
cagaagagauacagaggac

SEQ ID NO: 1158 - RNA, 19 nt, Artificial Sequence
  Description of Artificial Sequence: Synthetic oligonucleotide
caaggucuuuucaggauga

SEQ ID NO: 1159 - RNA, 19 nt, Artificial Sequence
  Description of Artificial Sequence: Synthetic oligonucleotide
auucuggagaaaacucaag

SEQ ID NO: 1160 - RNA, 19 nt, Artificial Sequence
  Description of Artificial Sequence: Synthetic oligonucleotide
uggaaaccacagugaauua

SEQ ID NO: 1161 - RNA, 19 nt, Artificial Sequence
  Description of Artificial Sequence: Synthetic oligonucleotide
gaaucucaaagaaaucuuu

SEQ ID NO: 1162 - RNA, 19 nt, Artificial Sequence
  Description of Artificial Sequence: Synthetic oligonucleotide
aaagaaaucuuugucuccu

SEQ ID NO: 1163 - RNA, 19 nt, Artificial Sequence
  Description of Artificial Sequence: Synthetic oligonucleotide
cuuuucaggaugauuuucu

SEQ ID NO: 1164 - RNA, 19 nt, Artificial Sequence
  Description of Artificial Sequence: Synthetic oligonucleotide
guauaaaauggcagaaagc

SEQ ID NO: 1165 - RNA, 19 nt, Artificial Sequence
  Description of Artificial Sequence: Synthetic oligonucleotide
uggucgaguacguggacug

SEQ ID NO: 1166 - RNA, 19 nt, Artificial Sequence
  Description of Artificial Sequence: Synthetic oligonucleotide
gcccaguacacgcauuaaa

SEQ ID NO: 1167 - RNA, 19 nt, Artificial Sequence
  Description of Artificial Sequence: Synthetic oligonucleotide
aucucuggauacacauuaa

SEQ ID NO: 1168 - RNA, 19 nt, Artificial Sequence
  Description of Artificial Sequence: Synthetic oligonucleotide
ggaauggcccaaagaaucu

SEQ ID NO: 1169 - RNA, 19 nt, Artificial Sequence
  Description of Artificial Sequence: Synthetic oligonucleotide
aagcucuuucugguuucag

SEQ ID NO: 1170 - RNA, 19 nt, Artificial Sequence
  Description of Artificial Sequence: Synthetic oligonucleotide
guuucuggugaauguguga

SEQ ID NO: 1171 - RNA, 19 nt, Artificial Sequence
  Description of Artificial Sequence: Synthetic oligonucleotide
ucucaaagaaaucuuuguc

SEQ ID NO: 1172 - RNA, 19 nt, Artificial Sequence
  Description of Artificial Sequence: Synthetic oligonucleotide
ccaaaggagauagaaaugu

SEQ ID NO: 1173 - RNA, 19 nt, Artificial Sequence
  Description of Artificial Sequence: Synthetic oligonucleotide
aagacaguguuacagaaac

SEQ ID NO: 1174 - RNA, 19 nt, Artificial Sequence
  Description of Artificial Sequence: Synthetic oligonucleotide
ggauuuucacugaaauccu

SEQ ID NO: 1175 - RNA, 19 nt, Artificial Sequence
  Description of Artificial Sequence: Synthetic oligonucleotide
cugugcucaaagggagcgg

SEQ ID NO: 1176 - RNA, 19 nt, Artificial Sequence
  Description of Artificial Sequence: Synthetic oligonucleotide
ggucgaguacguggacugg

SEQ ID NO: 1177 - RNA, 19 nt, Artificial Sequence
  Description of Artificial Sequence: Synthetic oligonucleotide
ucaacgacccauaugccug

SEQ ID NO: 1178 - RNA, 19 nt, Artificial Sequence
  Description of Artificial Sequence: Synthetic oligonucleotide
aagagauacagaggacaua

SEQ ID NO: 1179 - RNA, 19 nt, Artificial Sequence
  Description of Artificial Sequence: Synthetic oligonucleotide
guaccaccaaaaucaagcc

SEQ ID NO: 1180 - RNA, 19 nt, Artificial Sequence
  Description of Artificial Sequence: Synthetic oligonucleotide
guguggaggcuccaucauu

SEQ ID NO: 1181 - RNA, 19 nt, Artificial Sequence
  Description of Artificial Sequence: Synthetic oligonucleotide
uacacagauucucaacgac

SEQ ID NO: 1182 - RNA, 19 nt, Artificial Sequence
  Description of Artificial Sequence: Synthetic oligonucleotide
guuguguaaaauggauaau

SEQ ID NO: 1183 - RNA, 19 nt, Artificial Sequence
  Description of Artificial Sequence: Synthetic oligonucleotide
ccaagagugaauaggacag

SEQ ID NO: 1184 - RNA, 19 nt, Artificial Sequence
  Description of Artificial Sequence: Synthetic oligonucleotide
gagaagaacuggauauugu

SEQ ID NO: 1185 - RNA, 19 nt, Artificial Sequence
  Description of Artificial Sequence: Synthetic oligonucleotide
gcccaaagaaucucaaaga

SEQ ID NO: 1186 - RNA, 19 nt, Artificial Sequence
  Description of Artificial Sequence: Synthetic oligonucleotide
gaaacacugccaagaguga

SEQ ID NO: 1187 - RNA, 19 nt, Artificial Sequence
  Description of Artificial Sequence: Synthetic oligonucleotide
ucuggguauucuuucaagc

SEQ ID NO: 1188 - RNA, 19 nt, Artificial Sequence
  Description of Artificial Sequence: Synthetic oligonucleotide
gcggguaugauauugccuu

SEQ ID NO: 1189 - RNA, 19 nt, Artificial Sequence
  Description of Artificial Sequence: Synthetic oligonucleotide
ccacagugaauuacacaga

SEQ ID NO: 1190 - RNA, 19 nt, Artificial Sequence
  Description of Artificial Sequence: Synthetic oligonucleotide
uggaaaccaguggauauua

SEQ ID NO: 1191 - RNA, 19 nt, Artificial Sequence
  Description of Artificial Sequence: Synthetic oligonucleotide
uuucuggguauucuuucaa

SEQ ID NO: 1192 - RNA, 19 nt, Artificial Sequence
  Description of Artificial Sequence: Synthetic oligonucleotide
aaaccaguggauauuaaca

SEQ ID NO: 1193 - RNA, 19 nt, Artificial Sequence
  Description of Artificial Sequence: Synthetic oligonucleotide
cuucauuuuaccaugacac

SEQ ID NO: 1194 - RNA, 19 nt, Artificial Sequence
  Description of Artificial Sequence: Synthetic oligonucleotide
aggaauggcccaaagaauc

SEQ ID NO: 1195 - RNA, 19 nt, Artificial Sequence
  Description of Artificial Sequence: Synthetic oligonucleotide
ggaucguuggaggaacugc

SEQ ID NO: 1196 - RNA, 19 nt, Artificial Sequence
  Description of Artificial Sequence: Synthetic oligonucleotide
gucuacugaagcacaccca

SEQ ID NO: 1197 - RNA, 19 nt, Artificial Sequence
  Description of Artificial Sequence: Synthetic oligonucleotide
uuacuuaaagcuuucuuca

SEQ ID NO: 1198 - RNA, 19 nt, Artificial Sequence
  Description of Artificial Sequence: Synthetic oligonucleotide
acaaggucuuuucaggaug

SEQ ID NO: 1199 - RNA, 19 nt, Artificial Sequence
  Description of Artificial Sequence: Synthetic oligonucleotide
uguuacuuaaagcuuucuu

SEQ ID NO: 1200 - RNA, 19 nt, Artificial Sequence
  Description of Artificial Sequence: Synthetic oligonucleotide
aguguuacagaaacacugc

SEQ ID NO: 1201 - RNA, 19 nt, Artificial Sequence
  Description of Artificial Sequence: Synthetic oligonucleotide
ccuaagauuuugcgugucu

SEQ ID NO: 1202 - RNA, 19 nt, Artificial Sequence
  Description of Artificial Sequence: Synthetic oligonucleotide
uucaagcaaugcucacacc

SEQ ID NO: 1203 - RNA, 19 nt, Artificial Sequence
  Description of Artificial Sequence: Synthetic oligonucleotide
agcaaagcucuuucugguu

SEQ ID NO: 1204 - RNA, 19 nt, Artificial Sequence
  Description of Artificial Sequence: Synthetic oligonucleotide
aaauccugugcacuuucua

SEQ ID NO: 1205 - RNA, 19 nt, Artificial Sequence
  Description of Artificial Sequence: Synthetic oligonucleotide
aaaucaaucugaaauaaaa

SEQ ID NO: 1206 - RNA, 19 nt, Artificial Sequence
  Description of Artificial Sequence: Synthetic oligonucleotide
ugggagaagaacuggauau

SEQ ID NO: 1207 - RNA, 19 nt, Artificial Sequence
  Description of Artificial Sequence: Synthetic oligonucleotide
uacucuucacuuucacggc

SEQ ID NO: 1208 - RNA, 19 nt, Artificial Sequence
  Description of Artificial Sequence: Synthetic oligonucleotide
ugucuacugaagcacaccc

SEQ ID NO: 1209 - RNA, 19 nt, Artificial Sequence
  Description of Artificial Sequence: Synthetic oligonucleotide
ucgggaggcccucuguccu

SEQ ID NO: 1210 - RNA, 19 nt, Artificial Sequence
  Description of Artificial Sequence: Synthetic oligonucleotide
uuucaggaugauuuucuua

SEQ ID NO: 1211 - RNA, 19 nt, Artificial Sequence
  Description of Artificial Sequence: Synthetic oligonucleotide
auggcccaaagaaucucaa

SEQ ID NO: 1212 - RNA, 19 nt, Artificial Sequence
  Description of Artificial Sequence: Synthetic oligonucleotide
uuugucuccuuaaaacauc

SEQ ID NO: 1213 - RNA, 19 nt, Artificial Sequence
  Description of Artificial Sequence: Synthetic oligonucleotide
ggccugccagaaacugugc

SEQ ID NO: 1214 - RNA, 19 nt, Artificial Sequence
  Description of Artificial Sequence: Synthetic oligonucleotide
agaagaacuggauauuguu

SEQ ID NO: 1215 - RNA, 19 nt, Artificial Sequence
  Description of Artificial Sequence: Synthetic oligonucleotide
ucaguuucuggugaaugug

SEQ ID NO: 1216 - RNA, 19 nt, Artificial Sequence
  Description of Artificial Sequence: Synthetic oligonucleotide
ggguaugauauugccuugu

SEQ ID NO: 1217 - RNA, 19 nt, Artificial Sequence
  Description of Artificial Sequence: Synthetic oligonucleotide
agcccaggaucguuggagg

SEQ ID NO: 1218 - RNA, 19 nt, Artificial Sequence
  Description of Artificial Sequence: Synthetic oligonucleotide
agcucuuucugguuucagu

SEQ ID NO: 1219 - RNA, 19 nt, Artificial Sequence
  Description of Artificial Sequence: Synthetic oligonucleotide
acgcuugcaagggagauuc

SEQ ID NO: 1220 - RNA, 19 nt, Artificial Sequence
  Description of Artificial Sequence: Synthetic oligonucleotide
accacagugaauuacacag

SEQ ID NO: 1221 - RNA, 19 nt, Artificial Sequence
  Description of Artificial Sequence: Synthetic oligonucleotide
ucuggauuuucacugaaau

SEQ ID NO: 1222 - RNA, 19 nt, Artificial Sequence
  Description of Artificial Sequence: Synthetic oligonucleotide
gucuuuucaggaugauuuu

SEQ ID NO: 1223 - RNA, 19 nt, Artificial Sequence
  Description of Artificial Sequence: Synthetic oligonucleotide
aaauggauaaugaguguac

SEQ ID NO: 1224 - RNA, 19 nt, Artificial Sequence
  Description of Artificial Sequence: Synthetic oligonucleotide
uuacagaaacacugccaag

SEQ ID NO: 1225 - RNA, 19 nt, Artificial Sequence
  Description of Artificial Sequence: Synthetic oligonucleotide
auggauaaugaguguacca

SEQ ID NO: 1226 - RNA, 19 nt, Artificial Sequence
  Description of Artificial Sequence: Synthetic oligonucleotide
cgacccauaugccugccuu

SEQ ID NO: 1227 - RNA, 19 nt, Artificial Sequence
  Description of Artificial Sequence: Synthetic oligonucleotide
uugccuuguugaaacugga

SEQ ID NO: 1228 - RNA, 19 nt, Artificial Sequence
  Description of Artificial Sequence: Synthetic oligonucleotide
gcucaaagggagcggccag

SEQ ID NO: 1229 - RNA, 19 nt, Artificial Sequence
  Description of Artificial Sequence: Synthetic oligonucleotide
gaaacuggaaaccacagug

SEQ ID NO: 1230 - RNA, 19 nt, Artificial Sequence
  Description of Artificial Sequence: Synthetic oligonucleotide
cccaggaauggcccaaaga

SEQ ID NO: 1231 - RNA, 19 nt, Artificial Sequence
  Description of Artificial Sequence: Synthetic oligonucleotide
uucaggaugauuuucuuau

SEQ ID NO: 1232 - RNA, 19 nt, Artificial Sequence
  Description of Artificial Sequence: Synthetic oligonucleotide
caaucugaaauaaaagagg

SEQ ID NO: 1233 - RNA, 19 nt, Artificial Sequence
  Description of Artificial Sequence: Synthetic oligonucleotide
cccaaagaaucucaaagaa

SEQ ID NO: 1234 - RNA, 19 nt, Artificial Sequence
  Description of Artificial Sequence: Synthetic oligonucleotide
uguggaggcuccaucauug

SEQ ID NO: 1235 - RNA, 19 nt, Artificial Sequence
  Description of Artificial Sequence: Synthetic oligonucleotide
aguguucugccauucuuca

SEQ ID NO: 1236 - RNA, 19 nt, Artificial Sequence
  Description of Artificial Sequence: Synthetic oligonucleotide
guggaggcuccaucauugg

SEQ ID NO: 1237 - RNA, 19 nt, Artificial Sequence
  Description of Artificial Sequence: Synthetic oligonucleotide
ccuguguggaggcuccauc

SEQ ID NO: 1238 - RNA, 19 nt, Artificial Sequence
  Description of Artificial Sequence: Synthetic oligonucleotide
ugacacugauuucuuggga

SEQ ID NO: 1239 - RNA, 19 nt, Artificial Sequence
  Description of Artificial Sequence: Synthetic oligonucleotide
acaccuguguggaggcucc

SEQ ID NO: 1240 - RNA, 19 nt, Artificial Sequence
  Description of Artificial Sequence: Synthetic oligonucleotide
acacugauuucuugggaga

SEQ ID NO: 1241 - RNA, 19 nt, Artificial Sequence
  Description of Artificial Sequence: Synthetic oligonucleotide
gagacaccuguguggaggc

SEQ ID NO: 1242 - RNA, 19 nt, Artificial Sequence
  Description of Artificial Sequence: Synthetic oligonucleotide
uggaggcuccaucauugga

SEQ ID NO: 1243 - RNA, 19 nt, Artificial Sequence
  Description of Artificial Sequence: Synthetic oligonucleotide
aggcuccaucauuggaaac

SEQ ID NO: 1244 - RNA, 19 nt, Artificial Sequence
  Description of Artificial Sequence: Synthetic oligonucleotide
gacacugauuucuugggag

SEQ ID NO: 1245 - RNA, 19 nt, Artificial Sequence
  Description of Artificial Sequence: Synthetic oligonucleotide
gacaccuguguggaggcuc

SEQ ID NO: 1246 - RNA, 19 nt, Artificial Sequence
  Description of Artificial Sequence: Synthetic oligonucleotide
ugauuucuugggagaagaa

SEQ ID NO: 1247 - RNA, 19 nt, Artificial Sequence
  Description of Artificial Sequence: Synthetic oligonucleotide
ggcuccaucauuggaaacc

SEQ ID NO: 1248 - RNA, 19 nt, Artificial Sequence
  Description of Artificial Sequence: Synthetic oligonucleotide
ggaggcuccaucauuggaa

SEQ ID NO: 1249 - RNA, 19 nt, Artificial Sequence
  Description of Artificial Sequence: Synthetic oligonucleotide
accuguguggaggcuccau

SEQ ID NO: 1250 - RNA, 19 nt, Artificial Sequence
  Description of Artificial Sequence: Synthetic oligonucleotide
agacaccuguguggaggcu

SEQ ID NO: 1251 - RNA, 19 nt, Artificial Sequence
  Description of Artificial Sequence: Synthetic oligonucleotide
  modified_base (1)..(1): a, c, u, g, unknown or other
ncaaaaucuuaggugacuc

SEQ ID NO: 1252 - RNA, 19 nt, Artificial Sequence
  Description of Artificial Sequence: Synthetic oligonucleotide
  modified_base (1)..(1): a, c, u, g, unknown or other
nauugauuuaaaaugccac

SEQ ID NO: 1253 - RNA, 19 nt, Artificial Sequence
  Description of Artificial Sequence: Synthetic oligonucleotide
  modified_base (1)..(1): a, c, u, g, unknown or other
nagaaaucgcugcuguccu

SEQ ID NO: 1254 - RNA, 19 nt, Artificial Sequence
  Description of Artificial Sequence: Synthetic oligonucleotide
  modified_base (1)..(1): a, c, u, g, unknown or other
nauaagaaaaucauccuga

SEQ ID NO: 1255 - RNA, 19 nt, Artificial Sequence
  Description of Artificial Sequence: Synthetic oligonucleotide
  modified_base (1)..(1): a, c, u, g, unknown or other
naaacaccguauuagggaa

SEQ ID NO: 1256 - RNA, 19 nt, Artificial Sequence
  Description of Artificial Sequence: Synthetic oligonucleotide
  modified_base (1)..(1): a, c, u, g, unknown or other
naaaucagugucaugguaa

SEQ ID NO: 1257 - RNA, 19 nt, Artificial Sequence
  Description of Artificial Sequence: Synthetic oligonucleotide
  modified_base (1)..(1): a, c, u, g, unknown or other
nauacccgcuuucugccau

SEQ ID NO: 1258 - RNA, 19 nt, Artificial Sequence
  Description of Artificial Sequence: Synthetic oligonucleotide
  modified_base (1)..(1): a, c, u, g, unknown or other
nagauguuuuaaggagaca

SEQ ID NO: 1259 - RNA, 19 nt, Artificial Sequence
  Description of Artificial Sequence: Synthetic oligonucleotide
  modified_base (1)..(1): a, c, u, g, unknown or other
ngguaucuuggcuuucugg

SEQ ID NO: 1260 - RNA, 19 nt, Artificial Sequence
  Description of Artificial Sequence: Synthetic oligonucleotide
  modified_base (1)..(1): a, c, u, g, unknown or other
ncucuguaucucuucuggc

SEQ ID NO: 1261 - RNA, 19 nt, Artificial Sequence
  Description of Artificial Sequence: Synthetic oligonucleotide
  modified_base (1)..(1): a, c, u, g, unknown or other
nauggauuauuauuucuug

SEQ ID NO: 1262 - RNA, 19 nt, Artificial Sequence
  Description of Artificial Sequence: Synthetic oligonucleotide
  modified_base (1)..(1): a, c, u, g, unknown or other
nagccagauuagaaagugc

SEQ ID NO: 1263 - RNA, 19 nt, Artificial Sequence
  Description of Artificial Sequence: Synthetic oligonucleotide
  modified_base (1)..(1): a, c, u, g, unknown or other
nagcggacggcauuggugc

SEQ ID NO: 1264 - RNA, 19 nt, Artificial Sequence
  Description of Artificial Sequence: Synthetic oligonucleotide
  modified_base (1)..(1): a, c, u, g, unknown or other
nauuucagauugauuuaaa

SEQ ID NO: 1265 - RNA, 19 nt, Artificial Sequence
  Description of Artificial Sequence: Synthetic oligonucleotide
  modified_base (1)..(1): a, c, u, g, unknown or other
nuugucucuuaguuuucug

SEQ ID NO: 1266 - RNA, 19 nt, Artificial Sequence
  Description of Artificial Sequence: Synthetic oligonucleotide
  modified_base (1)..(1): a, c, u, g, unknown or other
nagaacacugggaugcugu

SEQ ID NO: 1267 - RNA, 19 nt, Artificial Sequence
  Description of Artificial Sequence: Synthetic oligonucleotide
  modified_base (1)..(1): a, c, u, g, unknown or other
nccacuugauauaagaaaa

SEQ ID NO: 1268 - RNA, 19 nt, Artificial Sequence
  Description of Artificial Sequence: Synthetic oligonucleotide
  modified_base (1)..(1): a, c, u, g, unknown or other
ncauuuucuuacaaacacc

SEQ ID NO: 1269 - RNA, 19 nt, Artificial Sequence
  Description of Artificial Sequence: Synthetic oligonucleotide
  modified_base (1)..(1): a, c, u, g, unknown or other
nuaaugcguguacugggca

SEQ ID NO: 1270 - RNA, 19 nt, Artificial Sequence
  Description of Artificial Sequence: Synthetic oligonucleotide
  modified_base (1)..(1): a, c, u, g, unknown or other
naggacagagggccucccg

SEQ ID NO: 1271 - RNA, 19 nt, Artificial Sequence
  Description of Artificial Sequence: Synthetic oligonucleotide
  modified_base (1)..(1): a, c, u, g, unknown or other
ncaaccgggaugaugagug

SEQ ID NO: 1272 - RNA, 19 nt, Artificial Sequence
  Description of Artificial Sequence: Synthetic oligonucleotide
  modified_base (1)..(1): a, c, u, g, unknown or other
ngacaaagauuucuuugag

SEQ ID NO: 1273 - RNA, 19 nt, Artificial Sequence
  Description of Artificial Sequence: Synthetic oligonucleotide
  modified_base (1)..(1): a, c, u, g, unknown or other
ngaggaagcaugcuggcac

SEQ ID NO: 1274 - RNA, 19 nt, Artificial Sequence
  Description of Artificial Sequence: Synthetic oligonucleotide
  modified_base (1)..(1): a, c, u, g, unknown or other
nggaaaaugucccuaauac

SEQ ID NO: 1275 - RNA, 19 nt, Artificial Sequence
  Description of Artificial Sequence: Synthetic oligonucleotide
  modified_base (1)..(1): a, c, u, g, unknown or other
nuuaaguaacacuugcccu

SEQ ID NO: 1276 - RNA, 19 nt, Artificial Sequence
  Description of Artificial Sequence: Synthetic oligonucleotide
  modified_base (1)..(1): a, c, u, g, unknown or other
ncaauaucauacccgcuuu

SEQ ID NO: 1277 - RNA, 19 nt, Artificial Sequence
  Description of Artificial Sequence: Synthetic oligonucleotide
  modified_base (1)..(1): a, c, u, g, unknown or other
naaauguaccacuugauau

SEQ ID NO: 1278 - RNA, 19 nt, Artificial Sequence
  Description of Artificial Sequence: Synthetic oligonucleotide
  modified_base (1)..(1): a, c, u, g, unknown or other
nagaaaaucauccugaaaa

SEQ ID NO: 1279 - RNA, 19 nt, Artificial Sequence
  Description of Artificial Sequence: Synthetic oligonucleotide
  modified_base (1)..(1): a, c, u, g, unknown or other
nuaacacuugcccuucccu

SEQ ID NO: 1280 - RNA, 19 nt, Artificial Sequence
  Description of Artificial Sequence: Synthetic oligonucleotide
  modified_base (1)..(1): a, c, u, g, unknown or other
nagcauuuucuuacaaaca

SEQ ID NO: 1281 - RNA, 19 nt, Artificial Sequence
  Description of Artificial Sequence: Synthetic oligonucleotide
  modified_base (1)..(1): a, c, u, g, unknown or other
ncaaacaccguauuaggga

SEQ ID NO: 1282 - RNA, 19 nt, Artificial Sequence
  Description of Artificial Sequence: Synthetic oligonucleotide
  modified_base (1)..(1): a, c, u, g, unknown or other
nagcggcuguuaauaucca

SEQ ID NO: 1283 - RNA, 19 nt, Artificial Sequence
  Description of Artificial Sequence: Synthetic oligonucleotide
  modified_base (1)..(1): a, c, u, g, unknown or other
ngagcggcuguuaauaucc

SEQ ID NO: 1284 - RNA, 19 nt, Artificial Sequence
  Description of Artificial Sequence: Synthetic oligonucleotide
  modified_base (1)..(1): a, c, u, g, unknown or other
ngagacaaagauuucuuug

SEQ ID NO: 1285 - RNA, 19 nt, Artificial Sequence
  Description of Artificial Sequence: Synthetic oligonucleotide
  modified_base (1)..(1): a, c, u, g, unknown or other
nuggguuauuuuauguccu

SEQ ID NO: 1286 - RNA, 19 nt, Artificial Sequence
  Description of Artificial Sequence: Synthetic oligonucleotide
  modified_base (1)..(1): a, c, u, g, unknown or other
ngagccaugacacugucga

SEQ ID NO: 1287 - RNA, 19 nt, Artificial Sequence
  Description of Artificial Sequence: Synthetic oligonucleotide
  modified_base (1)..(1): a, c, u, g, unknown or other
ncagauuagaaagugcaca

SEQ ID NO: 1288 - RNA, 19 nt, Artificial Sequence
  Description of Artificial Sequence: Synthetic oligonucleotide
  modified_base (1)..(1): a, c, u, g, unknown or other
nagaauacccagaaaucgc

SEQ ID NO: 1289 - RNA, 19 nt, Artificial Sequence
  Description of Artificial Sequence: Synthetic oligonucleotide
  modified_base (1)..(1): a, c, u, g, unknown or other
ncagauguuuuaaggagac

SEQ ID NO: 1290 - RNA, 19 nt, Artificial Sequence
  Description of Artificial Sequence: Synthetic oligonucleotide
  modified_base (1)..(1): a, c, u, g, unknown or other
nuguauccagagaugccuc

SEQ ID NO: 1291 - RNA, 19 nt, Artificial Sequence
  Description of Artificial Sequence: Synthetic oligonucleotide
  modified_base (1)..(1): a, c, u, g, unknown or other
ngagucacacauucaccag

SEQ ID NO: 1292 - RNA, 19 nt, Artificial Sequence
  Description of Artificial Sequence: Synthetic oligonucleotide
  modified_base (1)..(1): a, c, u, g, unknown or other
ncaaagaaagauguguccu

SEQ ID NO: 1293 - RNA, 19 nt, Artificial Sequence
  Description of Artificial Sequence: Synthetic oligonucleotide
  modified_base (1)..(1): a, c, u, g, unknown or other
naccacuugauauaagaaa

SEQ ID NO: 1294 - RNA, 20 nt, Artificial Sequence
  Description of Artificial Sequence: Synthetic oligonucleotide
  modified_base (1)..(1): a, c, u, g, unknown or other
nuaagaaagcuuuaaguaac

SEQ ID NO: 1295 - RNA, 19 nt, Artificial Sequence
  Description of Artificial Sequence: Synthetic oligonucleotide
  modified_base (1)..(1): a, c, u, g, unknown or other
nuuauuucagauugauuua

SEQ ID NO: 1296 - RNA, 19 nt, Artificial Sequence
  Description of Artificial Sequence: Synthetic oligonucleotide
  modified_base (1)..(1): a, c, u, g, unknown or other
nuggugugagcauugcuug

SEQ ID NO: 1297 - RNA, 19 nt, Artificial Sequence
  Description of Artificial Sequence: Synthetic oligonucleotide
  modified_base (1)..(1): a, c, u, g, unknown or other
naucauccugaaaagaccu

SEQ ID NO: 1298 - RNA, 19 nt, Artificial Sequence
  Description of Artificial Sequence: Synthetic oligonucleotide
  modified_base (1)..(1): a, c, u, g, unknown or other
ngugagcauugcuugaaag

SEQ ID NO: 1299 - RNA, 19 nt, Artificial Sequence
  Description of Artificial Sequence: Synthetic oligonucleotide
  modified_base (1)..(1): a, c, u, g, unknown or other
ncuguaucucuucuggcac

SEQ ID NO: 1300 - RNA, 19 nt, Artificial Sequence
  Description of Artificial Sequence: Synthetic oligonucleotide
  modified_base (1)..(1): a, c, u, g, unknown or other
naccuuaauguguauccag

SEQ ID NO: 1301 - RNA, 19 nt, Artificial Sequence
  Description of Artificial Sequence: Synthetic oligonucleotide
  modified_base (1)..(1): a, c, u, g, unknown or other
naucauggauuauuauuuc

SEQ ID NO: 1302 - RNA, 19 nt, Artificial Sequence
  Description of Artificial Sequence: Synthetic oligonucleotide
  modified_base (1)..(1): a, c, u, g, unknown or other
ncaaagauuucuuugagau

SEQ ID NO: 1303 - RNA, 19 nt, Artificial Sequence
  Description of Artificial Sequence: Synthetic oligonucleotide
  modified_base (1)..(1): a, c, u, g, unknown or other
ngaaguauuuuaguuggag

SEQ ID NO: 1304 - RNA, 19 nt, Artificial Sequence
  Description of Artificial Sequence: Synthetic oligonucleotide
  modified_base (1)..(1): a, c, u, g, unknown or other
nagauugauuuaaaaugcc

SEQ ID NO: 1305 - RNA, 19 nt, Artificial Sequence
  Description of Artificial Sequence: Synthetic oligonucleotide
  modified_base (1)..(1): a, c, u, g, unknown or other
nggguaucuuggcuuucug

SEQ ID NO: 1306 - RNA, 19 nt, Artificial Sequence
  Description of Artificial Sequence: Synthetic oligonucleotide
  modified_base (1)..(1): a, c, u, g, unknown or other
naggagacaaagauuucuu

SEQ ID NO: 1307 - RNA, 19 nt, Artificial Sequence
  Description of Artificial Sequence: Synthetic oligonucleotide
  modified_base (1)..(1): a, c, u, g, unknown or other
ngucaugguaaaaugaaga

SEQ ID NO: 1308 - RNA, 19 nt, Artificial Sequence
  Description of Artificial Sequence: Synthetic oligonucleotide
  modified_base (1)..(1): a, c, u, g, unknown or other
nauauccaguucuucuccc

SEQ ID NO: 1309 - RNA, 19 nt, Artificial Sequence
  Description of Artificial Sequence: Synthetic oligonucleotide
  modified_base (1)..(1): a, c, u, g, unknown or other
naauauccaguucuucucc

SEQ ID NO: 1310 - RNA, 19 nt, Artificial Sequence
  Description of Artificial Sequence: Synthetic oligonucleotide
  modified_base (1)..(1): a, c, u, g, unknown or other
ncugugguuuccaguuuca

SEQ ID NO: 1311 - RNA, 19 nt, Artificial Sequence
  Description of Artificial Sequence: Synthetic oligonucleotide
  modified_base (1)..(1): a, c, u, g, unknown or other
nagauuagaaagugcacag

SEQ ID NO: 1312 - RNA, 19 nt, Artificial Sequence
  Description of Artificial Sequence: Synthetic oligonucleotide
  modified_base (1)..(1): a, c, u, g, unknown or other
nagaaaucagugucauggu

SEQ ID NO: 1313 - RNA, 19 nt, Artificial Sequence
  Description of Artificial Sequence: Synthetic oligonucleotide
  modified_base (1)..(1): a, c, u, g, unknown or other
nuggauuauuauuucuuga

SEQ ID NO: 1314 - RNA, 19 nt, Artificial Sequence
  Description of Artificial Sequence: Synthetic oligonucleotide
  modified_base (1)..(1): a, c, u, g, unknown or other
nccagauuagaaagugcac

SEQ ID NO: 1315 - RNA, 19 nt, Artificial Sequence
  Description of Artificial Sequence: Synthetic oligonucleotide
  modified_base (1)..(1): a, c, u, g, unknown or other
ncucauuauccauuuuaca

SEQ ID NO: 1316 - RNA, 19 nt, Artificial Sequence
  Description of Artificial Sequence: Synthetic oligonucleotide
  modified_base (1)..(1): a, c, u, g, unknown or other
nuugggccauuccugggaa

SEQ ID NO: 1317 - RNA, 19 nt, Artificial Sequence
  Description of Artificial Sequence: Synthetic oligonucleotide
  modified_base (1)..(1): a, c, u, g, unknown or other
nugggcuugauuuuggugg

SEQ ID NO: 1318 - RNA, 19 nt, Artificial Sequence
  Description of Artificial Sequence: Synthetic oligonucleotide
  modified_base (1)..(1): a, c, u, g, unknown or other
ncagauugauuuaaaaugc

SEQ ID NO: 1319 - RNA, 19 nt, Artificial Sequence
  Description of Artificial Sequence: Synthetic oligonucleotide
  modified_base (1)..(1): a, c, u, g, unknown or other
naagcaaccgggaugauga

SEQ ID NO: 1320 - RNA, 19 nt, Artificial Sequence
  Description of Artificial Sequence: Synthetic oligonucleotide
  modified_base (1)..(1): a, c, u, g, unknown or other
ncuuaauguguauccagag

SEQ ID NO: 1321 - RNA, 19 nt, Artificial Sequence
  Description of Artificial Sequence: Synthetic oligonucleotide
  modified_base (1)..(1): a, c, u, g, unknown or other
nguaauucacugugguuuc

SEQ ID NO: 1322 - RNA, 19 nt, Artificial Sequence
  Description of Artificial Sequence: Synthetic oligonucleotide
  modified_base (1)..(1): a, c, u, g, unknown or other
nacauuucuaucuccuuug

SEQ ID NO: 1323 - RNA, 19 nt, Artificial Sequence
  Description of Artificial Sequence: Synthetic oligonucleotide
  modified_base (1)..(1): a, c, u, g, unknown or other
ncacugguuuccaaugaug

SEQ ID NO: 1324 - RNA, 19 nt, Artificial Sequence
  Description of Artificial Sequence: Synthetic oligonucleotide
  modified_base (1)..(1): a, c, u, g, unknown or other
ngaaucuguguaauucacu

SEQ ID NO: 1325 - RNA, 19 nt, Artificial Sequence
  Description of Artificial Sequence: Synthetic oligonucleotide
  modified_base (1)..(1): a, c, u, g, unknown or other
nguccuauucacucuuggc

SEQ ID NO: 1326 - RNA, 19 nt, Artificial Sequence
  Description of Artificial Sequence: Synthetic oligonucleotide
  modified_base (1)..(1): a, c, u, g, unknown or other
nagcauugcuugaaagaau

SEQ ID NO: 1327 - RNA, 19 nt, Artificial Sequence
  Description of Artificial Sequence: Synthetic oligonucleotide
  modified_base (1)..(1): a, c, u, g, unknown or other
naauacccagaaaucgcug

SEQ ID NO: 1328 - RNA, 19 nt, Artificial Sequence
  Description of Artificial Sequence: Synthetic oligonucleotide
  modified_base (1)..(1): a, c, u, g, unknown or other
nauuauuauuucuugaacc

SEQ ID NO: 1329 - RNA, 19 nt, Artificial Sequence
  Description of Artificial Sequence: Synthetic oligonucleotide
  modified_base (1)..(1): a, c, u, g, unknown or other
naaguauuuuaguuggaga

SEQ ID NO: 1330 - RNA, 19 nt, Artificial Sequence
  Description of Artificial Sequence: Synthetic oligonucleotide
  modified_base (1)..(1): a, c, u, g, unknown or other
ngaauccaguccacguacu

SEQ ID NO: 1331 - RNA, 19 nt, Artificial Sequence
  Description of Artificial Sequence: Synthetic oligonucleotide
  modified_base (1)..(1): a, c, u, g, unknown or other
nagacaaagauuucuuuga

SEQ ID NO: 1332 - RNA, 19 nt, Artificial Sequence
  Description of Artificial Sequence: Synthetic oligonucleotide
  modified_base (1)..(1): a, c, u, g, unknown or other
nacaggauuucagugaaaa

SEQ ID NO: 1333 - RNA, 19 nt, Artificial Sequence
  Description of Artificial Sequence: Synthetic oligonucleotide
  modified_base (1)..(1): a, c, u, g, unknown or other
naacaaggcaauaucauac

SEQ ID NO: 1334 - RNA, 19 nt, Artificial Sequence
  Description of Artificial Sequence: Synthetic oligonucleotide
  modified_base (1)..(1): a, c, u, g, unknown or other
naaggcaauaucauacccg

SEQ ID NO: 1335 - RNA, 19 nt, Artificial Sequence
  Description of Artificial Sequence: Synthetic oligonucleotide
  modified_base (1)..(1): a, c, u, g, unknown or other
nauacccagaaaucgcugc

SEQ ID NO: 1336 - RNA, 19 nt, Artificial Sequence
  Description of Artificial Sequence: Synthetic oligonucleotide
  modified_base (1)..(1): a, c, u, g, unknown or other
ngauugauuuaaaaugcca

SEQ ID NO: 1337 - RNA, 19 nt, Artificial Sequence
  Description of Artificial Sequence: Synthetic oligonucleotide
  modified_base (1)..(1): a, c, u, g, unknown or other
nccuauucacucuuggcag

SEQ ID NO: 1338 - RNA, 19 nt, Artificial Sequence
  Description of Artificial Sequence: Synthetic oligonucleotide
  modified_base (1)..(1): a, c, u, g, unknown or other
nguagacacgcaaaaucuu

SEQ ID NO: 1339 - RNA, 19 nt, Artificial Sequence
  Description of Artificial Sequence: Synthetic oligonucleotide
  modified_base (1)..(1): a, c, u, g, unknown or other
nugaguuuucuccagaauc

SEQ ID NO: 1340 - RNA, 19 nt, Artificial Sequence
  Description of Artificial Sequence: Synthetic oligonucleotide
  modified_base (1)..(1): a, c, u, g, unknown or other
nauuucuuugagauucuuu

SEQ ID NO: 1341 - RNA, 19 nt, Artificial Sequence
  Description of Artificial Sequence: Synthetic oligonucleotide
  modified_base (1)..(1): a, c, u, g, unknown or other
nuauaagaaaaucauccug

SEQ ID NO: 1342 - RNA, 19 nt, Artificial Sequence
  Description of Artificial Sequence: Synthetic oligonucleotide
  modified_base (1)..(1): a, c, u, g, unknown or other
naaaaucuuaggugacucu

SEQ ID NO: 1343 - RNA, 19 nt, Artificial Sequence
  Description of Artificial Sequence: Synthetic oligonucleotide
  modified_base (1)..(1): a, c, u, g, unknown or other
nacacugggaugcugugcc

SEQ ID NO: 1344 - RNA, 19 nt, Artificial Sequence
  Description of Artificial Sequence: Synthetic oligonucleotide
  modified_base (1)..(1): a, c, u, g, unknown or other
nugcacaggauuucaguga

SEQ ID NO: 1345 - RNA, 19 nt, Artificial Sequence
  Description of Artificial Sequence: Synthetic oligonucleotide
  modified_base (1)..(1): a, c, u, g, unknown or other
nauacaagccagauuagaa

SEQ ID NO: 1346 - RNA, 19 nt, Artificial Sequence
  Description of Artificial Sequence: Synthetic oligonucleotide
  modified_base (1)..(1): a, c, u, g, unknown or other
nugugguuuccaguuucaa

SEQ ID NO: 1347 - RNA, 19 nt, Artificial Sequence
  Description of Artificial Sequence: Synthetic oligonucleotide
  modified_base (1)..(1): a, c, u, g, unknown or other
nugcccuucccuucguugc

SEQ ID NO: 1348 - RNA, 19 nt, Artificial Sequence
  Description of Artificial Sequence: Synthetic oligonucleotide
  modified_base (1)..(1): a, c, u, g, unknown or other
naaaaucauccugaaaaga

SEQ ID NO: 1349 - RNA, 19 nt, Artificial Sequence
  Description of Artificial Sequence: Synthetic oligonucleotide
  modified_base (1)..(1): a, c, u, g, unknown or other
nccaagaaaucagugucau

SEQ ID NO: 1350 - RNA, 19 nt, Artificial Sequence
  Description of Artificial Sequence: Synthetic oligonucleotide
  modified_base (1)..(1): a, c, u, g, unknown or other
nggcauaugggucguugag

SEQ ID NO: 1351 - RNA, 19 nt, Artificial Sequence
  Description of Artificial Sequence: Synthetic oligonucleotide
  modified_base (1)..(1): a, c, u, g, unknown or other
nagaaucuguguaauucac

SEQ ID NO: 1352 - RNA, 19 nt, Artificial Sequence
  Description of Artificial Sequence: Synthetic oligonucleotide
  modified_base (1)..(1): a, c, u, g, unknown or other
nauccaguccacguacucg

SEQ ID NO: 1353 - RNA, 19 nt, Artificial Sequence
  Description of Artificial Sequence: Synthetic oligonucleotide
  modified_base (1)..(1): a, c, u, g, unknown or other
nccucuguaucucuucugg

SEQ ID NO: 1354 - RNA, 19 nt, Artificial Sequence
  Description of Artificial Sequence: Synthetic oligonucleotide
  modified_base (1)..(1): a, c, u, g, unknown or other
ngcacaggauuucagugaa

SEQ ID NO: 1355 - RNA, 19 nt, Artificial Sequence
  Description of Artificial Sequence: Synthetic oligonucleotide
  modified_base (1)..(1): a, c, u, g, unknown or other
nguaaaaugaagaauggca

SEQ ID NO: 1356 - RNA, 19 nt, Artificial Sequence
  Description of Artificial Sequence: Synthetic oligonucleotide
  modified_base (1)..(1): a, c, u, g, unknown or other
ngucguugagaaucugugu

SEQ ID NO: 1357 - RNA, 19 nt, Artificial Sequence
  Description of Artificial Sequence: Synthetic oligonucleotide
  modified_base (1)..(1): a, c, u, g, unknown or other
ngcaacaauauccaguucu

SEQ ID NO: 1358 - RNA, 19 nt, Artificial Sequence
  Description of Artificial Sequence: Synthetic oligonucleotide
  modified_base (1)..(1): a, c, u, g, unknown or other
ncagcggacggcauuggug

SEQ ID NO: 1359 - RNA, 19 nt, Artificial Sequence
  Description of Artificial Sequence: Synthetic oligonucleotide
  modified_base (1)..(1): a, c, u, g, unknown or other
ngaaagcuuuaaguaacac

SEQ ID NO: 1360 - RNA, 19 nt, Artificial Sequence
  Description of Artificial Sequence: Synthetic oligonucleotide
  modified_base (1)..(1): a, c, u, g, unknown or other
ngcaguguuucuguaacac

SEQ ID NO: 1361 - RNA, 19 nt, Artificial Sequence
  Description of Artificial Sequence: Synthetic oligonucleotide
  modified_base (1)..(1): a, c, u, g, unknown or other
ngagaaucuguguaauuca

SEQ ID NO: 1362 - RNA, 19 nt, Artificial Sequence
  Description of Artificial Sequence: Synthetic oligonucleotide
  modified_base (1)..(1): a, c, u, g, unknown or other
nuccaguccacguacucga

SEQ ID NO: 1363 - RNA, 19 nt, Artificial Sequence
  Description of Artificial Sequence: Synthetic oligonucleotide
  modified_base (1)..(1): a, c, u, g, unknown or other
nugugagcauugcuugaaa

SEQ ID NO: 1364 - RNA, 19 nt, Artificial Sequence
  Description of Artificial Sequence: Synthetic oligonucleotide
  modified_base (1)..(1): a, c, u, g, unknown or other
nccgggaugaugagugcag

SEQ ID NO: 1365 - RNA, 19 nt, Artificial Sequence
  Description of Artificial Sequence: Synthetic oligonucleotide
  modified_base (1)..(1): a, c, u, g, unknown or other
nccacuuuaucgagcuucg

SEQ ID NO: 1366 - RNA, 19 nt, Artificial Sequence
  Description of Artificial Sequence: Synthetic oligonucleotide
  modified_base (1)..(1): a, c, u, g, unknown or other
ncauuauccauuuuacaca

SEQ ID NO: 1367 - RNA, 19 nt, Artificial Sequence
  Description of Artificial Sequence: Synthetic oligonucleotide
  modified_base (1)..(1): a, c, u, g, unknown or other
naaccgggaugaugagugc

SEQ ID NO: 1368 - RNA, 19 nt, Artificial Sequence
  Description of Artificial Sequence: Synthetic oligonucleotide
  modified_base (1)..(1): a, c, u, g, unknown or other
nuucuuugggccauuccug

SEQ ID NO: 1369 - RNA, 19 nt, Artificial Sequence
  Description of Artificial Sequence: Synthetic oligonucleotide
  modified_base (1)..(1): a, c, u, g, unknown or other
ncuaaggguaucuuggcuu

SEQ ID NO: 1370 - RNA, 19 nt, Artificial Sequence
  Description of Artificial Sequence: Synthetic oligonucleotide
  modified_base (1)..(1): a, c, u, g, unknown or other
nuuggugugagcauugcuu

SEQ ID NO: 1371 - RNA, 19 nt, Artificial Sequence
  Description of Artificial Sequence: Synthetic oligonucleotide
  modified_base (1)..(1): a, c, u, g, unknown or other
ncauaugggucguugagaa

SEQ ID NO: 1372 - RNA, 19 nt, Artificial Sequence
  Description of Artificial Sequence: Synthetic oligonucleotide
  modified_base (1)..(1): a, c, u, g, unknown or other
nuuaauguguauccagaga

SEQ ID NO: 1373 - RNA, 19 nt, Artificial Sequence
  Description of Artificial Sequence: Synthetic oligonucleotide
  modified_base (1)..(1): a, c, u, g, unknown or other
nucagauguuuuaaggaga

SEQ ID NO: 1374 - RNA, 19 nt, Artificial Sequence
  Description of Artificial Sequence: Synthetic oligonucleotide
  modified_base (1)..(1): a, c, u, g, unknown or other
nuuccaaugauggagccuc

SEQ ID NO: 1375 - RNA, 19 nt, Artificial Sequence
  Description of Artificial Sequence: Synthetic oligonucleotide
  modified_base (1)..(1): a, c, u, g, unknown or other
nagaauccaguccacguac

SEQ ID NO: 1376 - RNA, 19 nt, Artificial Sequence
  Description of Artificial Sequence: Synthetic oligonucleotide
  modified_base (1)..(1): a, c, u, g, unknown or other
nuuugagauucuuugggcc

SEQ ID NO: 1377 - RNA, 19 nt, Artificial Sequence
  Description of Artificial Sequence: Synthetic oligonucleotide
  modified_base (1)..(1): a, c, u, g, unknown or other
naaucauccugaaaagacc

SEQ ID NO: 1378 - RNA, 19 nt, Artificial Sequence
  Description of Artificial Sequence: Synthetic oligonucleotide
  modified_base (1)..(1): a, c, u, g, unknown or other
nagacacgcaaaaucuuag

SEQ ID NO: 1379 - RNA, 19 nt, Artificial Sequence
  Description of Artificial Sequence: Synthetic oligonucleotide
  modified_base (1)..(1): a, c, u, g, unknown or other
ncguacucgaccacguugg

SEQ ID NO: 1380 - RNA, 19 nt, Artificial Sequence
  Description of Artificial Sequence: Synthetic oligonucleotide
  modified_base (1)..(1): a, c, u, g, unknown or other
ncauccagucacccagcaa

SEQ ID NO: 1381 - RNA, 19 nt, Artificial Sequence
  Description of Artificial Sequence: Synthetic oligonucleotide
  modified_base (1)..(1): a, c, u, g, unknown or other
naacacugggaugcugugc

SEQ ID NO: 1382 - RNA, 19 nt, Artificial Sequence
  Description of Artificial Sequence: Synthetic oligonucleotide
  modified_base (1)..(1): a, c, u, g, unknown or other
ncagaaagagcuuugcucu

SEQ ID NO: 1383 - RNA, 19 nt, Artificial Sequence
  Description of Artificial Sequence: Synthetic oligonucleotide
  modified_base (1)..(1): a, c, u, g, unknown or other
nuucuuugagauucuuugg

SEQ ID NO: 1384 - RNA, 19 nt, Artificial Sequence
  Description of Artificial Sequence: Synthetic oligonucleotide
  modified_base (1)..(1): a, c, u, g, unknown or other
nagcaacaauauccaguuc

SEQ ID NO: 1385 - RNA, 19 nt, Artificial Sequence
  Description of Artificial Sequence: Synthetic oligonucleotide
  modified_base (1)..(1): a, c, u, g, unknown or other
naccacuuuaucgagcuuc

SEQ ID NO: 1386 - RNA, 19 nt, Artificial Sequence
  Description of Artificial Sequence: Synthetic oligonucleotide
  modified_base (1)..(1): a, c, u, g, unknown or other
ncccuucccuucguugcag

SEQ ID NO: 1387 - RNA, 19 nt, Artificial Sequence
  Description of Artificial Sequence: Synthetic oligonucleotide
  modified_base (1)..(1): a, c, u, g, unknown or other
ncgcaaaaucuuaggugac

SEQ ID NO: 1388 - RNA, 19 nt, Artificial Sequence
  Description of Artificial Sequence: Synthetic oligonucleotide
  modified_base (1)..(1): a, c, u, g, unknown or other
nagcguguuacuguggagg

SEQ ID NO: 1389 - RNA, 19 nt, Artificial Sequence
  Description of Artificial Sequence: Synthetic oligonucleotide
  modified_base (1)..(1): a, c, u, g, unknown or other
ncuccuucccuguagccgg

SEQ ID NO: 1390 - RNA, 19 nt, Artificial Sequence
  Description of Artificial Sequence: Synthetic oligonucleotide
  modified_base (1)..(1): a, c, u, g, unknown or other
nguccucuguaucucuucu

SEQ ID NO: 1391 - RNA, 19 nt, Artificial Sequence
  Description of Artificial Sequence: Synthetic oligonucleotide
  modified_base (1)..(1): a, c, u, g, unknown or other
nguaucuuggcuuucugga

SEQ ID NO: 1392 - RNA, 19 nt, Artificial Sequence
  Description of Artificial Sequence: Synthetic oligonucleotide
  modified_base (1)..(1): a, c, u, g, unknown or other
ncucuuggcaguguuucug

SEQ ID NO: 1393 - RNA, 19 nt, Artificial Sequence
  Description of Artificial Sequence: Synthetic oligonucleotide
  modified_base (1)..(1): a, c, u, g, unknown or other
ngaaaucagugucauggua

SEQ ID NO: 1394 - RNA, 19 nt, Artificial Sequence
  Description of Artificial Sequence: Synthetic oligonucleotide
  modified_base (1)..(1): a, c, u, g, unknown or other
ncuucccuguagccggcac

SEQ ID NO: 1395 - RNA, 19 nt, Artificial Sequence
  Description of Artificial Sequence: Synthetic oligonucleotide
  modified_base (1)..(1): a, c, u, g, unknown or other
ncuggccgcucccuuugag

SEQ ID NO: 1396 - RNA, 19 nt, Artificial Sequence
  Description of Artificial Sequence: Synthetic oligonucleotide
  modified_base (1)..(1): a, c, u, g, unknown or other
ncacgcaaaaucuuaggug

SEQ ID NO: 1397 - RNA, 19 nt, Artificial Sequence
  Description of Artificial Sequence: Synthetic oligonucleotide
  modified_base (1)..(1): a, c, u, g, unknown or other
ngaaaccagaaagagcuuu

SEQ ID NO: 1398 - RNA, 19 nt, Artificial Sequence
  Description of Artificial Sequence: Synthetic oligonucleotide
  modified_base (1)..(1): a, c, u, g, unknown or other
naaagcuuuaaguaacacu

SEQ ID NO: 1399 - RNA, 19 nt, Artificial Sequence
  Description of Artificial Sequence: Synthetic oligonucleotide
  modified_base (1)..(1): a, c, u, g, unknown or other
nacaagccagauuagaaag

SEQ ID NO: 1400 - RNA, 19 nt, Artificial Sequence
  Description of Artificial Sequence: Synthetic oligonucleotide
  modified_base (1)..(1): a, c, u, g, unknown or other
nacucauuauccauuuuac

SEQ ID NO: 1401 - RNA, 19 nt, Artificial Sequence
  Description of Artificial Sequence: Synthetic oligonucleotide
  modified_base (1)..(1): a, c, u, g, unknown or other
nccugaaaagaccuuguug

SEQ ID NO: 1402 - RNA, 19 nt, Artificial Sequence
  Description of Artificial Sequence: Synthetic oligonucleotide
  modified_base (1)..(1): a, c, u, g, unknown or other
ngguuuccaaugauggagc

SEQ ID NO: 1403 - RNA, 19 nt, Artificial Sequence
  Description of Artificial Sequence: Synthetic oligonucleotide
  modified_base (1)..(1): a, c, u, g, unknown or other
ncaguuucuggcaggccuc

SEQ ID NO: 1404 - RNA, 19 nt, Artificial Sequence
  Description of Artificial Sequence: Synthetic oligonucleotide
  modified_base (1)..(1): a, c, u, g, unknown or other
nauggcagaacacugggau

SEQ ID NO: 1405 - RNA, 19 nt, Artificial Sequence
  Description of Artificial Sequence: Synthetic oligonucleotide
  modified_base (1)..(1): a, c, u, g, unknown or other
nagauuucuuugagauucu

SEQ ID NO: 1406 - RNA, 19 nt, Artificial Sequence
  Description of Artificial Sequence: Synthetic oligonucleotide
  modified_base (1)..(1): a, c, u, g, unknown or other
nguuuccaguuucaacaag

SEQ ID NO: 1407 - RNA, 19 nt, Artificial Sequence
  Description of Artificial Sequence: Synthetic oligonucleotide
  modified_base (1)..(1): a, c, u, g, unknown or other
nuccucuguaucucuucug

SEQ ID NO: 1408 - RNA, 19 nt, Artificial Sequence
  Description of Artificial Sequence: Synthetic oligonucleotide
  modified_base (1)..(1): a, c, u, g, unknown or other
ncauccugaaaagaccuug

SEQ ID NO: 1409 - RNA, 19 nt, Artificial Sequence
  Description of Artificial Sequence: Synthetic oligonucleotide
  modified_base (1)..(1): a, c, u, g, unknown or other
nuugaguuuucuccagaau

SEQ ID NO: 1410 - RNA, 19 nt, Artificial Sequence
  Description of Artificial Sequence: Synthetic oligonucleotide
  modified_base (1)..(1): a, c, u, g, unknown or other
naauucacugugguuucca

SEQ ID NO: 1411 - RNA, 19 nt, Artificial Sequence
  Description of Artificial Sequence: Synthetic oligonucleotide
  modified_base (1)..(1): a, c, u, g, unknown or other
naagauuucuuugagauuc

SEQ ID NO: 1412 - RNA, 19 nt, Artificial Sequence
  Description of Artificial Sequence: Synthetic oligonucleotide
  modified_base (1)..(1): a, c, u, g, unknown or other
nggagacaaagauuucuuu

SEQ ID NO: 1413 - RNA, 19 nt, Artificial Sequence
  Description of Artificial Sequence: Synthetic oligonucleotide
  modified_base (1)..(1): a, c, u, g, unknown or other
ngaaaaucauccugaaaag

SEQ ID NO: 1414 - RNA, 19 nt, Artificial Sequence
  Description of Artificial Sequence: Synthetic oligonucleotide
  modified_base (1)..(1): a, c, u, g, unknown or other
ncuuucugccauuuuauac

SEQ ID NO: 1415 - RNA, 19 nt, Artificial Sequence
  Description of Artificial Sequence: Synthetic oligonucleotide
  modified_base (1)..(1): a, c, u, g, unknown or other
naguccacguacucgacca

SEQ ID NO: 1416 - RNA, 19 nt, Artificial Sequence
  Description of Artificial Sequence: Synthetic oligonucleotide
  modified_base (1)..(1): a, c, u, g, unknown or other
nuuaaugcguguacugggc

SEQ ID NO: 1417 - RNA, 19 nt, Artificial Sequence
  Description of Artificial Sequence: Synthetic oligonucleotide
  modified_base (1)..(1): a, c, u, g, unknown or other
nuaauguguauccagagau

SEQ ID NO: 1418 - RNA, 19 nt, Artificial Sequence
  Description of Artificial Sequence: Synthetic oligonucleotide
  modified_base (1)..(1): a, c, u, g, unknown or other
ngauucuuugggccauucc

SEQ ID NO: 1419 - RNA, 19 nt, Artificial Sequence
  Description of Artificial Sequence: Synthetic oligonucleotide
  modified_base (1)..(1): a, c, u, g, unknown or other
nugaaaccagaaagagcuu

SEQ ID NO: 1420 - RNA, 19 nt, Artificial Sequence
  Description of Artificial Sequence: Synthetic oligonucleotide
  modified_base (1)..(1): a, c, u, g, unknown or other
ncacacauucaccagaaac

SEQ ID NO: 1421 - RNA, 19 nt, Artificial Sequence
  Description of Artificial Sequence: Synthetic oligonucleotide
  modified_base (1)..(1): a, c, u, g, unknown or other
nacaaagauuucuuugaga

SEQ ID NO: 1422 - RNA, 19 nt, Artificial Sequence
  Description of Artificial Sequence: Synthetic oligonucleotide
  modified_base (1)..(1): a, c, u, g, unknown or other
ncauuucuaucuccuuugg

SEQ ID NO: 1423 - RNA, 19 nt, Artificial Sequence
  Description of Artificial Sequence: Synthetic oligonucleotide
  modified_base (1)..(1): a, c, u, g, unknown or other
nuuucuguaacacugucuu

SEQ ID NO: 1424 - RNA, 19 nt, Artificial Sequence
  Description of Artificial Sequence: Synthetic oligonucleotide
  modified_base (1)..(1): a, c, u, g, unknown or other
nggauuucagugaaaaucc

SEQ ID NO: 1425 - RNA, 19 nt, Artificial Sequence
  Description of Artificial Sequence: Synthetic oligonucleotide
  modified_base (1)..(1): a, c, u, g, unknown or other
ncgcucccuuugagcacag

SEQ ID NO: 1426 - RNA, 19 nt, Artificial Sequence
  Description of Artificial Sequence: Synthetic oligonucleotide
  modified_base (1)..(1): a, c, u, g, unknown or other
ncaguccacguacucgacc

SEQ ID NO: 1427 - RNA, 19 nt, Artificial Sequence
  Description of Artificial Sequence: Synthetic oligonucleotide
  modified_base (1)..(1): a, c, u, g, unknown or other
naggcauaugggucguuga

SEQ ID NO: 1428 - RNA, 19 nt, Artificial Sequence
  Description of Artificial Sequence: Synthetic oligonucleotide
  modified_base (1)..(1): a, c, u, g, unknown or other
nauguccucuguaucucuu

SEQ ID NO: 1429 - RNA, 19 nt, Artificial Sequence
  Description of Artificial Sequence: Synthetic oligonucleotide
  modified_base (1)..(1): a, c, u, g, unknown or other
ngcuugauuuuggugguac

SEQ ID NO: 1430 - RNA, 19 nt, Artificial Sequence
  Description of Artificial Sequence: Synthetic oligonucleotide
  modified_base (1)..(1): a, c, u, g, unknown or other
naugauggagccuccacac

SEQ ID NO: 1431 - RNA, 19 nt, Artificial Sequence
  Description of Artificial Sequence: Synthetic oligonucleotide
  modified_base (1)..(1): a, c, u, g, unknown or other
nucguugagaaucugugua

SEQ ID NO: 1432 - RNA, 19 nt, Artificial Sequence
  Description of Artificial Sequence: Synthetic oligonucleotide
  modified_base (1)..(1): a, c, u, g, unknown or other
nuuauccauuuuacacaac

SEQ ID NO: 1433 - RNA, 19 nt, Artificial Sequence
  Description of Artificial Sequence: Synthetic oligonucleotide
  modified_base (1)..(1): a, c, u, g, unknown or other
nuguccuauucacucuugg

SEQ ID NO: 1434 - RNA, 19 nt, Artificial Sequence
  Description of Artificial Sequence: Synthetic oligonucleotide
  modified_base (1)..(1): a, c, u, g, unknown or other
ncaauauccaguucuucuc

SEQ ID NO: 1435 - RNA, 19 nt, Artificial Sequence
  Description of Artificial Sequence: Synthetic oligonucleotide
  modified_base (1)..(1): a, c, u, g, unknown or other
ncuuugagauucuuugggc

SEQ ID NO: 1436 - RNA, 19 nt, Artificial Sequence
  Description of Artificial Sequence: Synthetic oligonucleotide
  modified_base (1)..(1): a, c, u, g, unknown or other
ncacucuuggcaguguuuc

SEQ ID NO: 1437 - RNA, 19 nt, Artificial Sequence
  Description of Artificial Sequence: Synthetic oligonucleotide
  modified_base (1)..(1): a, c, u, g, unknown or other
ncuugaaagaauacccaga

SEQ ID NO: 1438 - RNA, 19 nt, Artificial Sequence
  Description of Artificial Sequence: Synthetic oligonucleotide
  modified_base (1)..(1): a, c, u, g, unknown or other
naggcaauaucauacccgc

SEQ ID NO: 1439 - RNA, 19 nt, Artificial Sequence
  Description of Artificial Sequence: Synthetic oligonucleotide
  modified_base (1)..(1): a, c, u, g, unknown or other
ncuguguaauucacugugg

SEQ ID NO: 1440 - RNA, 19 nt, Artificial Sequence
  Description of Artificial Sequence: Synthetic oligonucleotide
  modified_base (1)..(1): a, c, u, g, unknown or other
naauauccacugguuucca

SEQ ID NO: 1441 - RNA, 19 nt, Artificial Sequence
  Description of Artificial Sequence: Synthetic oligonucleotide
  modified_base (1)..(1): a, c, u, g, unknown or other
nugaaagaauacccagaaa

SEQ ID NO: 1442 - RNA, 19 nt, Artificial Sequence
  Description of Artificial Sequence: Synthetic oligonucleotide
  modified_base (1)..(1): a, c, u, g, unknown or other
nguuaauauccacugguuu

SEQ ID NO: 1443 - RNA, 19 nt, Artificial Sequence
  Description of Artificial Sequence: Synthetic oligonucleotide
  modified_base (1)..(1): a, c, u, g, unknown or other
nugucaugguaaaaugaag

SEQ ID NO: 1444 - RNA, 19 nt, Artificial Sequence
  Description of Artificial Sequence: Synthetic oligonucleotide
  modified_base (1)..(1): a, c, u, g, unknown or other
nauucuuugggccauuccu

SEQ ID NO: 1445 - RNA, 19 nt, Artificial Sequence
  Description of Artificial Sequence: Synthetic oligonucleotide
  modified_base (1)..(1): a, c, u, g, unknown or other
ncaguuccuccaacgaucc

SEQ ID NO: 1446 - RNA, 19 nt, Artificial Sequence
  Description of Artificial Sequence: Synthetic oligonucleotide
  modified_base (1)..(1): a, c, u, g, unknown or other
ngggugugcuucaguagac

SEQ ID NO: 1447 - RNA, 19 nt, Artificial Sequence
  Description of Artificial Sequence: Synthetic oligonucleotide
  modified_base (1)..(1): a, c, u, g, unknown or other
ngaagaaagcuuuaaguaa

SEQ ID NO: 1448 - RNA, 19 nt, Artificial Sequence
  Description of Artificial Sequence: Synthetic oligonucleotide
  modified_base (1)..(1): a, c, u, g, unknown or other
nauccugaaaagaccuugu

SEQ ID NO: 1449 - RNA, 19 nt, Artificial Sequence
  Description of Artificial Sequence: Synthetic oligonucleotide
  modified_base (1)..(1): a, c, u, g, unknown or other
nagaaagcuuuaaguaaca

SEQ ID NO: 1450 - RNA, 19 nt, Artificial Sequence
  Description of Artificial Sequence: Synthetic oligonucleotide
  modified_base (1)..(1): a, c, u, g, unknown or other
ncaguguuucuguaacacu

SEQ ID NO: 1451 - RNA, 19 nt, Artificial Sequence
  Description of Artificial Sequence: Synthetic oligonucleotide
  modified_base (1)..(1): a, c, u, g, unknown or other
ngacacgcaaaaucuuagg

SEQ ID NO: 1452 - RNA, 19 nt, Artificial Sequence
  Description of Artificial Sequence: Synthetic oligonucleotide
  modified_base (1)..(1): a, c, u, g, unknown or other
ngugugagcauugcuugaa

SEQ ID NO: 1453 - RNA, 19 nt, Artificial Sequence
  Description of Artificial Sequence: Synthetic oligonucleotide
  modified_base (1)..(1): a, c, u, g, unknown or other
naccagaaagagcuuugcu

SEQ ID NO: 1454 - RNA, 19 nt, Artificial Sequence
  Description of Artificial Sequence: Synthetic oligonucleotide
  modified_base (1)..(1): a, c, u, g, unknown or other
nagaaagugcacaggauuu

SEQ ID NO: 1455 - RNA, 19 nt, Artificial Sequence
  Description of Artificial Sequence: Synthetic oligonucleotide
  modified_base (1)..(1): a, c, u, g, unknown or other
nuuuauuucagauugauuu

SEQ ID NO: 1456 - RNA, 19 nt, Artificial Sequence
  Description of Artificial Sequence: Synthetic oligonucleotide
  modified_base (1)..(1): a, c, u, g, unknown or other
nuauccaguucuucuccca

SEQ ID NO: 1457 - RNA, 19 nt, Artificial Sequence
  Description of Artificial Sequence: Synthetic oligonucleotide
  modified_base (1)..(1): a, c, u, g, unknown or other
nccgugaaagugaagagua

SEQ ID NO: 1458 - RNA, 19 nt, Artificial Sequence
  Description of Artificial Sequence: Synthetic oligonucleotide
  modified_base (1)..(1): a, c, u, g, unknown or other
nggugugcuucaguagaca

SEQ ID NO: 1459 - RNA, 19 nt, Artificial Sequence
  Description of Artificial Sequence: Synthetic oligonucleotide
  modified_base (1)..(1): a, c, u, g, unknown or other
nggacagagggccucccga

SEQ ID NO: 1460 - RNA, 19 nt, Artificial Sequence
  Description of Artificial Sequence: Synthetic oligonucleotide
  modified_base (1)..(1): a, c, u, g, unknown or other
naagaaaaucauccugaaa

SEQ ID NO: 1461 - RNA, 19 nt, Artificial Sequence
  Description of Artificial Sequence: Synthetic oligonucleotide
  modified_base (1)..(1): a, c, u, g, unknown or other
nugagauucuuugggccau

SEQ ID NO: 1462 - RNA, 19 nt, Artificial Sequence
  Description of Artificial Sequence: Synthetic oligonucleotide
  modified_base (1)..(1): a, c, u, g, unknown or other
nauguuuuaaggagacaaa

SEQ ID NO: 1463 - RNA, 19 nt, Artificial Sequence
  Description of Artificial Sequence: Synthetic oligonucleotide
  modified_base (1)..(1): a, c, u, g, unknown or other
ncacaguuucuggcaggcc

SEQ ID NO: 1464 - RNA, 19 nt, Artificial Sequence
  Description of Artificial Sequence: Synthetic oligonucleotide
  modified_base (1)..(1): a, c, u, g, unknown or other
nacaauauccaguucuucu

SEQ ID NO: 1465 - RNA, 19 nt, Artificial Sequence
  Description of Artificial Sequence: Synthetic oligonucleotide
  modified_base (1)..(1): a, c, u, g, unknown or other
nacauucaccagaaacuga

SEQ ID NO: 1466 - RNA, 19 nt, Artificial Sequence
  Description of Artificial Sequence: Synthetic oligonucleotide
  modified_base (1)..(1): a, c, u, g, unknown or other
ncaaggcaauaucauaccc

SEQ ID NO: 1467 - RNA, 19 nt, Artificial Sequence
  Description of Artificial Sequence: Synthetic oligonucleotide
  modified_base (1)..(1): a, c, u, g, unknown or other
ncuccaacgauccugggcu

SEQ ID NO: 1468 - RNA, 19 nt, Artificial Sequence
  Description of Artificial Sequence: Synthetic oligonucleotide
  modified_base (1)..(1): a, c, u, g, unknown or other
ncugaaaccagaaagagcu

SEQ ID NO: 1469 - RNA, 19 nt, Artificial Sequence
  Description of Artificial Sequence: Synthetic oligonucleotide
  modified_base (1)..(1): a, c, u, g, unknown or other
naaucucccuugcaagcgu

SEQ ID NO: 1470 - RNA, 19 nt, Artificial Sequence
  Description of Artificial Sequence: Synthetic oligonucleotide
  modified_base (1)..(1): a, c, u, g, unknown or other
nuguguaauucacuguggu

SEQ ID NO: 1471 - RNA, 19 nt, Artificial Sequence
  Description of Artificial Sequence: Synthetic oligonucleotide
  modified_base (1)..(1): a, c, u, g, unknown or other
nuuucagugaaaauccaga

SEQ ID NO: 1472 - RNA, 19 nt, Artificial Sequence
  Description of Artificial Sequence: Synthetic oligonucleotide
  modified_base (1)..(1): a, c, u, g, unknown or other
naaaucauccugaaaagac

SEQ ID NO: 1473 - RNA, 19 nt, Artificial Sequence
  Description of Artificial Sequence: Synthetic oligonucleotide
  modified_base (1)..(1): a, c, u, g, unknown or other
nuacacucauuauccauuu

SEQ ID NO: 1474 - RNA, 19 nt, Artificial Sequence
  Description of Artificial Sequence: Synthetic oligonucleotide
  modified_base (1)..(1): a, c, u, g, unknown or other
nuuggcaguguuucuguaa

SEQ ID NO: 1475 - RNA, 19 nt, Artificial Sequence
  Description of Artificial Sequence: Synthetic oligonucleotide
  modified_base (1)..(1): a, c, u, g, unknown or other
ngguacacucauuauccau

SEQ ID NO: 1476 - RNA, 19 nt, Artificial Sequence
  Description of Artificial Sequence: Synthetic oligonucleotide
  modified_base (1)..(1): a, c, u, g, unknown or other
naggcaggcauaugggucg

SEQ ID NO: 1477 - RNA, 19 nt, Artificial Sequence
  Description of Artificial Sequence: Synthetic oligonucleotide
  modified_base (1)..(1): a, c, u, g, unknown or other
nccaguuucaacaaggcaa

SEQ ID NO: 1478 - RNA, 19 nt, Artificial Sequence
  Description of Artificial Sequence: Synthetic oligonucleotide
  modified_base (1)..(1): a, c, u, g, unknown or other
nuggccgcucccuuugagc

SEQ ID NO: 1479 - RNA, 19 nt, Artificial Sequence
  Description of Artificial Sequence: Synthetic oligonucleotide
  modified_base (1)..(1): a, c, u, g, unknown or other
nacugugguuuccaguuuc

SEQ ID NO: 1480 - RNA, 19 nt, Artificial Sequence
  Description of Artificial Sequence: Synthetic oligonucleotide
  modified_base (1)..(1): a, c, u, g, unknown or other
ncuuugggccauuccuggg

SEQ ID NO: 1481 - RNA, 19 nt, Artificial Sequence
  Description of Artificial Sequence: Synthetic oligonucleotide
  modified_base (1)..(1): a, c, u, g, unknown or other
nuaagaaaaucauccugaa

SEQ ID NO: 1482 - RNA, 19 nt, Artificial Sequence
  Description of Artificial Sequence: Synthetic oligonucleotide
  modified_base (1)..(1): a, c, u, g, unknown or other
ncucuuuuauuucagauug

SEQ ID NO: 1483 - RNA, 19 nt, Artificial Sequence
  Description of Artificial Sequence: Synthetic oligonucleotide
  modified_base (1)..(1): a, c, u, g, unknown or other
nucuuugagauucuuuggg

SEQ ID NO: 1484 - RNA, 19 nt, Artificial Sequence
  Description of Artificial Sequence: Synthetic oligonucleotide
  modified_base (1)..(1): a, c, u, g, unknown or other
naaugauggagccuccaca

SEQ ID NO: 1485 - RNA, 19 nt, Artificial Sequence
  Description of Artificial Sequence: Synthetic oligonucleotide
  modified_base (1)..(1): a, c, u, g, unknown or other
ngaagaauggcagaacacu

SEQ ID NO: 1486 - RNA, 19 nt, Artificial Sequence
  Description of Artificial Sequence: Synthetic oligonucleotide
  modified_base (1)..(1): a, c, u, g, unknown or other
ncaaugauggagccuccac

SEQ ID NO: 1487 - RNA, 19 nt, Artificial Sequence
  Description of Artificial Sequence: Synthetic oligonucleotide
  modified_base (1)..(1): a, c, u, g, unknown or other
nauggagccuccacacagg

SEQ ID NO: 1488 - RNA, 19 nt, Artificial Sequence
  Description of Artificial Sequence: Synthetic oligonucleotide
  modified_base (1)..(1): a, c, u, g, unknown or other
ncccaagaaaucaguguca

SEQ ID NO: 1489 - RNA, 19 nt, Artificial Sequence
  Description of Artificial Sequence: Synthetic oligonucleotide
  modified_base (1)..(1): a, c, u, g, unknown or other
ngagccuccacacaggugu

SEQ ID NO: 1490 - RNA, 19 nt, Artificial Sequence
  Description of Artificial Sequence: Synthetic oligonucleotide
  modified_base (1)..(1): a, c, u, g, unknown or other
ncucccaagaaaucagugu

SEQ ID NO: 1491 - RNA, 19 nt, Artificial Sequence
  Description of Artificial Sequence: Synthetic oligonucleotide
  modified_base (1)..(1): a, c, u, g, unknown or other
nccuccacacaggugucuc

SEQ ID NO: 1492 - RNA, 19 nt, Artificial Sequence
  Description of Artificial Sequence: Synthetic oligonucleotide
  modified_base (1)..(1): a, c, u, g, unknown or other
nccaaugauggagccucca

SEQ ID NO: 1493 - RNA, 19 nt, Artificial Sequence
  Description of Artificial Sequence: Synthetic oligonucleotide
  modified_base (1)..(1): a, c, u, g, unknown or other
nuuuccaaugauggagccu

SEQ ID NO: 1494 - RNA, 19 nt, Artificial Sequence
  Description of Artificial Sequence: Synthetic oligonucleotide
  modified_base (1)..(1): a, c, u, g, unknown or other
nucccaagaaaucaguguc

SEQ ID NO: 1495 - RNA, 19 nt, Artificial Sequence
  Description of Artificial Sequence: Synthetic oligonucleotide
  modified_base (1)..(1): a, c, u, g, unknown or other
nagccuccacacagguguc

SEQ ID NO: 1496 - RNA, 19 nt, Artificial Sequence
  Description of Artificial Sequence: Synthetic oligonucleotide
  modified_base (1)..(1): a, c, u, g, unknown or other
nucuucucccaagaaauca

SEQ ID NO: 1497 - RNA, 19 nt, Artificial Sequence
  Description of Artificial Sequence: Synthetic oligonucleotide
  modified_base (1)..(1): a, c, u, g, unknown or other
nguuuccaaugauggagcc

SEQ ID NO: 1498 - RNA, 19 nt, Artificial Sequence
  Description of Artificial Sequence: Synthetic oligonucleotide
  modified_base (1)..(1): a, c, u, g, unknown or other
nuccaaugauggagccucc

SEQ ID NO: 1499 - RNA, 19 nt, Artificial Sequence
  Description of Artificial Sequence: Synthetic oligonucleotide
  modified_base (1)..(1): a, c, u, g, unknown or other
nuggagccuccacacaggu

SEQ ID NO: 1500 - RNA, 19 nt, Artificial Sequence
  Description of Artificial Sequence: Synthetic oligonucleotide
  modified_base (1)..(1): a, c, u, g, unknown or other
ngccuccacacaggugucu

SEQ ID NO: 1501 - RNA, 15 nt, Artificial Sequence
  Description of Artificial Sequence: Synthetic oligonucleotide
  modified_base (15)..(15): a, c, u, g, unknown or other
caccuaagauuuugn

SEQ ID NO: 1502 - RNA, 15 nt, Artificial Sequence
  Description of Artificial Sequence: Synthetic oligonucleotide
  modified_base (15)..(15): a, c, u, g, unknown or other
cauuuuaaaucaaun

SEQ ID NO: 1503 - RNA, 15 nt, Artificial Sequence
  Description of Artificial Sequence: Synthetic oligonucleotide
  modified_base (15)..(15): a, c, u, g, unknown or other
cagcagcgauuucun

SEQ ID NO: 1504 - RNA, 15 nt, Artificial Sequence
  Description of Artificial Sequence: Synthetic oligonucleotide
  modified_base (15)..(15): a, c, u, g, unknown or other
gaugauuuucuuaun

SEQ ID NO: 1505 - RNA, 15 nt, Artificial Sequence
  Description of Artificial Sequence: Synthetic oligonucleotide
  modified_base (15)..(15): a, c, u, g, unknown or other
cuaauacgguguuun

SEQ ID NO: 1506 - RNA, 15 nt, Artificial Sequence
  Description of Artificial Sequence: Synthetic oligonucleotide
  modified_base (15)..(15): a, c, u, g, unknown or other
caugacacugauuun

SEQ ID NO: 1507 - RNA, 15 nt, Artificial Sequence
  Description of Artificial Sequence: Synthetic oligonucleotide
  modified_base (15)..(15): a, c, u, g, unknown or other
cagaaagcggguaun

SEQ ID NO: 1508 - RNA, 15 nt, Artificial Sequence
  Description of Artificial Sequence: Synthetic oligonucleotide
  modified_base (15)..(15): a, c, u, g, unknown or other
uccuuaaaacaucun

SEQ ID NO: 1509 - RNA, 15 nt, Artificial Sequence
  Description of Artificial Sequence: Synthetic oligonucleotide
  modified_base (15)..(15): a, c, u, g, unknown or other
aaagccaagauaccn

SEQ ID NO: 1510 - RNA, 15 nt, Artificial Sequence
  Description of Artificial Sequence: Synthetic oligonucleotide
  modified_base (15)..(15): a, c, u, g, unknown or other
gaagagauacagagn

SEQ ID NO: 1511 - RNA, 15 nt, Artificial Sequence
  Description of Artificial Sequence: Synthetic oligonucleotide
  modified_base (15)..(15): a, c, u, g, unknown or other
aaauaauaauccaun

SEQ ID NO: 1512 - RNA, 15 nt, Artificial Sequence
  Description of Artificial Sequence: Synthetic oligonucleotide
  modified_base (15)..(15): a, c, u, g, unknown or other
uuucuaaucuggcun

SEQ ID NO: 1513 - RNA, 15 nt, Artificial Sequence
  Description of Artificial Sequence: Synthetic oligonucleotide
  modified_base (15)..(15): a, c, u, g, unknown or other
caaugccguccgcun

SEQ ID NO: 1514 - RNA, 15 nt, Artificial Sequence
  Description of Artificial Sequence: Synthetic oligonucleotide
  modified_base (15)..(15): a, c, u, g, unknown or other
aaucaaucugaaaun

SEQ ID NO: 1515 - RNA, 15 nt, Artificial Sequence
  Description of Artificial Sequence: Synthetic oligonucleotide
  modified_base (15)..(15): a, c, u, g, unknown or other
aaacuaagagacaan

SEQ ID NO: 1516 - RNA, 15 nt, Artificial Sequence
  Description of Artificial Sequence: Synthetic oligonucleotide
  modified_base (15)..(15): a, c, u, g, unknown or other
caucccaguguucun

SEQ ID NO: 1517 - RNA, 15 nt, Artificial Sequence
  Description of Artificial Sequence: Synthetic oligonucleotide
  modified_base (15)..(15): a, c, u, g, unknown or other
cuuauaucaaguggn

SEQ ID NO: 1518 - RNA, 15 nt, Artificial Sequence
  Description of Artificial Sequence: Synthetic oligonucleotide
  modified_base (15)..(15): a, c, u, g, unknown or other
uuuguaagaaaaugn

SEQ ID NO: 1519 - RNA, 15 nt, Artificial Sequence
  Description of Artificial Sequence: Synthetic oligonucleotide
  modified_base (15)..(15): a, c, u, g, unknown or other
caguacacgcauuan

SEQ ID NO: 1520 - RNA, 15 nt, Artificial Sequence
  Description of Artificial Sequence: Synthetic oligonucleotide
  modified_base (15)..(15): a, c, u, g, unknown or other
aggcccucuguccun

SEQ ID NO: 1521 - RNA, 15 nt, Artificial Sequence
  Description of Artificial Sequence: Synthetic oligonucleotide
  modified_base (15)..(15): a, c, u, g, unknown or other
caucaucccgguugn

SEQ ID NO: 1522 - RNA, 15 nt, Artificial Sequence
  Description of Artificial Sequence: Synthetic oligonucleotide
  modified_base (15)..(15): a, c, u, g, unknown or other
aagaaaucuuugucn

SEQ ID NO: 1523 - RNA, 15 nt, Artificial Sequence
  Description of Artificial Sequence: Synthetic oligonucleotide
  modified_base (15)..(15): a, c, u, g, unknown or other
cagcaugcuuccucn

SEQ ID NO: 1524 - RNA, 15 nt, Artificial Sequence
  Description of Artificial Sequence: Synthetic oligonucleotide
  modified_base (15)..(15): a, c, u, g, unknown or other
uagggacauuuuccn

SEQ ID NO: 1525 - RNA, 15 nt, Artificial Sequence
  Description of Artificial Sequence: Synthetic oligonucleotide
  modified_base (15)..(15): a, c, u, g, unknown or other
caaguguuacuuaan

SEQ ID NO: 1526 - RNA, 15 nt, Artificial Sequence
  Description of Artificial Sequence: Synthetic oligonucleotide
  modified_base (15)..(15): a, c, u, g, unknown or other
cggguaugauauugn

SEQ ID NO: 1527 - RNA, 15 nt, Artificial Sequence
  Description of Artificial Sequence: Synthetic oligonucleotide
  modified_base (15)..(15): a, c, u, g, unknown or other
caagugguacauuun

SEQ ID NO: 1528 - RNA, 15 nt, Artificial Sequence
  Description of Artificial Sequence: Synthetic oligonucleotide
  modified_base (15)..(15): a, c, u, g, unknown or other
caggaugauuuucun

SEQ ID NO: 1529 - RNA, 15 nt, Artificial Sequence
  Description of Artificial Sequence: Synthetic oligonucleotide
  modified_base (15)..(15): a, c, u, g, unknown or other
aagggcaaguguuan

SEQ ID NO: 1530 - RNA, 15 nt, Artificial Sequence
  Description of Artificial Sequence: Synthetic oligonucleotide
  modified_base (15)..(15): a, c, u, g, unknown or other
uguaagaaaaugcun

SEQ ID NO: 1531 - RNA, 15 nt, Artificial Sequence
  Description of Artificial Sequence: Synthetic oligonucleotide
  modified_base (15)..(15): a, c, u, g, unknown or other
uaauacgguguuugn

SEQ ID NO: 1532 - RNA, 15 nt, Artificial Sequence
  Description of Artificial Sequence: Synthetic oligonucleotide
  modified_base (15)..(15): a, c, u, g, unknown or other
uauuaacagccgcun

SEQ ID NO: 1533 - RNA, 15 nt, Artificial Sequence
  Description of Artificial Sequence: Synthetic oligonucleotide
  modified_base (15)..(15): a, c, u, g, unknown or other
auuaacagccgcucn

SEQ ID NO: 1534 - RNA, 15 nt, Artificial Sequence
  Description of Artificial Sequence: Synthetic oligonucleotide
  modified_base (15)..(15): a, c, u, g, unknown or other
gaaaucuuugucucn

SEQ ID NO: 1535 - RNA, 15 nt, Artificial Sequence
  Description of Artificial Sequence: Synthetic oligonucleotide
  modified_base (15)..(15): a, c, u, g, unknown or other
cauaaaauaacccan

SEQ ID NO: 1536 - RNA, 15 nt, Artificial Sequence
  Description of Artificial Sequence: Synthetic oligonucleotide
  modified_base (15)..(15): a, c, u, g, unknown or other
cagugucauggcucn

SEQ ID NO: 1537 - RNA, 15 nt, Artificial Sequence
  Description of Artificial Sequence: Synthetic oligonucleotide
  modified_base (15)..(15): a, c, u, g, unknown or other
cacuuucuaaucugn

SEQ ID NO: 1538 - RNA, 15 nt, Artificial Sequence
  Description of Artificial Sequence: Synthetic oligonucleotide
  modified_base (15)..(15): a, c, u, g, unknown or other
uuucuggguauucun

SEQ ID NO: 1539 - RNA, 15 nt, Artificial Sequence
  Description of Artificial Sequence: Synthetic oligonucleotide
  modified_base (15)..(15): a, c, u, g, unknown or other
ccuuaaaacaucugn

SEQ ID NO: 1540 - RNA, 15 nt, Artificial Sequence
  Description of Artificial Sequence: Synthetic oligonucleotide
  modified_base (15)..(15): a, c, u, g, unknown or other
caucucuggauacan

SEQ ID NO: 1541 - RNA, 15 nt, Artificial Sequence
  Description of Artificial Sequence: Synthetic oligonucleotide
  modified_base (15)..(15): a, c, u, g, unknown or other
ugaaugugugacucn

SEQ ID NO: 1542 - RNA, 15 nt, Artificial Sequence
  Description of Artificial Sequence: Synthetic oligonucleotide
  modified_base (15)..(15): a, c, u, g, unknown or other
cacaucuuucuuugn

SEQ ID NO: 1543 - RNA, 15 nt, Artificial Sequence
  Description of Artificial Sequence: Synthetic oligonucleotide
  modified_base (15)..(15): a, c, u, g, unknown or other
uuauaucaaguggun

SEQ ID NO: 1544 - RNA, 15 nt, Artificial Sequence
  Description of Artificial Sequence: Synthetic oligonucleotide
  modified_base (15)..(15): a, c, u, g, unknown or other
cuuaaagcuuucuun

SEQ ID NO: 1545 - RNA, 15 nt, Artificial Sequence
  Description of Artificial Sequence: Synthetic oligonucleotide
  modified_base (15)..(15): a, c, u, g, unknown or other
ucaaucugaaauaan

SEQ ID NO: 1546 - RNA, 15 nt, Artificial Sequence
  Description of Artificial Sequence: Synthetic oligonucleotide
  modified_base (15)..(15): a, c, u, g, unknown or other
caaugcucacaccan

SEQ ID NO: 1547 - RNA, 15 nt, Artificial Sequence
  Description of Artificial Sequence: Synthetic oligonucleotide
  modified_base (15)..(15): a, c, u, g, unknown or other
cuuuucaggaugaun

SEQ ID NO: 1548 - RNA, 15 nt, Artificial Sequence
  Description of Artificial Sequence: Synthetic oligonucleotide
  modified_base (15)..(15): a, c, u, g, unknown or other
caagcaaugcucacn

SEQ ID NO: 1549 - RNA, 15 nt, Artificial Sequence
  Description of Artificial Sequence: Synthetic oligonucleotide
  modified_base (15)..(15): a, c, u, g, unknown or other
cagaagagauacagn

SEQ ID NO: 1550 - RNA, 15 nt, Artificial Sequence
  Description of Artificial Sequence: Synthetic oligonucleotide
  modified_base (15)..(15): a, c, u, g, unknown or other
auacacauuaaggun

SEQ ID NO: 1551 - RNA, 15 nt, Artificial Sequence
  Description of Artificial Sequence: Synthetic oligonucleotide
  modified_base (15)..(15): a, c, u, g, unknown or other
uaauaauccaugaun

SEQ ID NO: 1552 - RNA, 15 nt, Artificial Sequence
  Description of Artificial Sequence: Synthetic oligonucleotide
  modified_base (15)..(15): a, c, u, g, unknown or other
caaagaaaucuuugn

SEQ ID NO: 1553 - RNA, 15 nt, Artificial Sequence
  Description of Artificial Sequence: Synthetic oligonucleotide
  modified_base (15)..(15): a, c, u, g, unknown or other
aacuaaaauacuucn

SEQ ID NO: 1554 - RNA, 15 nt, Artificial Sequence
  Description of Artificial Sequence: Synthetic oligonucleotide
  modified_base (15)..(15): a, c, u, g, unknown or other
uuuuaaaucaaucun

SEQ ID NO: 1555 - RNA, 15 nt, Artificial Sequence
  Description of Artificial Sequence: Synthetic oligonucleotide
  modified_base (15)..(15): a, c, u, g, unknown or other
aagccaagauacccn

SEQ ID NO: 1556 - RNA, 15 nt, Artificial Sequence
  Description of Artificial Sequence: Synthetic oligonucleotide
  modified_base (15)..(15): a, c, u, g, unknown or other
aaucuuugucuccun

SEQ ID NO: 1557 - RNA, 15 nt, Artificial Sequence
  Description of Artificial Sequence: Synthetic oligonucleotide
  modified_base (15)..(15): a, c, u, g, unknown or other
cauuuuaccaugacn

SEQ ID NO: 1558 - RNA, 15 nt, Artificial Sequence
  Description of Artificial Sequence: Synthetic oligonucleotide
  modified_base (15)..(15): a, c, u, g, unknown or other
gaagaacuggauaun

SEQ ID NO: 1559 - RNA, 15 nt, Artificial Sequence
  Description of Artificial Sequence: Synthetic oligonucleotide
  modified_base (15)..(15): a, c, u, g, unknown or other
aagaacuggauauun

SEQ ID NO: 1560 - RNA, 15 nt, Artificial Sequence
  Description of Artificial Sequence: Synthetic oligonucleotide
  modified_base (15)..(15): a, c, u, g, unknown or other
acuggaaaccacagn

SEQ ID NO: 1561 - RNA, 15 nt, Artificial Sequence
  Description of Artificial Sequence: Synthetic oligonucleotide
  modified_base (15)..(15): a, c, u, g, unknown or other
gcacuuucuaaucun

SEQ ID NO: 1562 - RNA, 15 nt, Artificial Sequence
  Description of Artificial Sequence: Synthetic oligonucleotide
  modified_base (15)..(15): a, c, u, g, unknown or other
ugacacugauuucun

SEQ ID NO: 1563 - RNA, 15 nt, Artificial Sequence
  Description of Artificial Sequence: Synthetic oligonucleotide
  modified_base (15)..(15): a, c, u, g, unknown or other
gaaauaauaauccan

SEQ ID NO: 1564 - RNA, 15 nt, Artificial Sequence
  Description of Artificial Sequence: Synthetic oligonucleotide
  modified_base (15)..(15): a, c, u, g, unknown or other
acuuucuaaucuggn

SEQ ID NO: 1565 - RNA, 15 nt, Artificial Sequence
  Description of Artificial Sequence: Synthetic oligonucleotide
  modified_base (15)..(15): a, c, u, g, unknown or other
aaauggauaaugagn

SEQ ID NO: 1566 - RNA, 15 nt, Artificial Sequence
  Description of Artificial Sequence: Synthetic oligonucleotide
  modified_base (15)..(15): a, c, u, g, unknown or other
caggaauggcccaan

SEQ ID NO: 1567 - RNA, 15 nt, Artificial Sequence
  Description of Artificial Sequence: Synthetic oligonucleotide
  modified_base (15)..(15): a, c, u, g, unknown or other
caaaaucaagcccan

SEQ ID NO: 1568 - RNA, 15 nt, Artificial Sequence
  Description of Artificial Sequence: Synthetic oligonucleotide
  modified_base (15)..(15): a, c, u, g, unknown or other
uuuaaaucaaucugn

SEQ ID NO: 1569 - RNA, 15 nt, Artificial Sequence
  Description of Artificial Sequence: Synthetic oligonucleotide
  modified_base (15)..(15): a, c, u, g, unknown or other
caucccgguugcuun

SEQ ID NO: 1570 - RNA, 15 nt, Artificial Sequence
  Description of Artificial Sequence: Synthetic oligonucleotide
  modified_base (15)..(15): a, c, u, g, unknown or other
ggauacacauuaagn

SEQ ID NO: 1571 - RNA, 15 nt, Artificial Sequence
  Description of Artificial Sequence: Synthetic oligonucleotide
  modified_base (15)..(15): a, c, u, g, unknown or other
ccacagugaauuacn

SEQ ID NO: 1572 - RNA, 15 nt, Artificial Sequence
  Description of Artificial Sequence: Synthetic oligonucleotide
  modified_base (15)..(15): a, c, u, g, unknown or other
ggagauagaaaugun

SEQ ID NO: 1573 - RNA, 15 nt, Artificial Sequence
  Description of Artificial Sequence: Synthetic oligonucleotide
  modified_base (15)..(15): a, c, u, g, unknown or other
auuggaaaccagugn

SEQ ID NO: 1574 - RNA, 15 nt, Artificial Sequence
  Description of Artificial Sequence: Synthetic oligonucleotide
  modified_base (15)..(15): a, c, u, g, unknown or other
aauuacacagauucn

SEQ ID NO: 1575 - RNA, 15 nt, Artificial Sequence
  Description of Artificial Sequence: Synthetic oligonucleotide
  modified_base (15)..(15): a, c, u, g, unknown or other
agagugaauaggacn

SEQ ID NO: 1576 - RNA, 15 nt, Artificial Sequence
  Description of Artificial Sequence: Synthetic oligonucleotide
  modified_base (15)..(15): a, c, u, g, unknown or other
uuucaagcaaugcun

SEQ ID NO: 1577 - RNA, 15 nt, Artificial Sequence
  Description of Artificial Sequence: Synthetic oligonucleotide
  modified_base (15)..(15): a, c, u, g, unknown or other
gauuucuggguauun

SEQ ID NO: 1578 - RNA, 15 nt, Artificial Sequence
  Description of Artificial Sequence: Synthetic oligonucleotide
  modified_base (15)..(15): a, c, u, g, unknown or other
caagaaauaauaaun

SEQ ID NO: 1579 - RNA, 15 nt, Artificial Sequence
  Description of Artificial Sequence: Synthetic oligonucleotide
  modified_base (15)..(15): a, c, u, g, unknown or other
caacuaaaauacuun

SEQ ID NO: 1580 - RNA, 15 nt, Artificial Sequence
  Description of Artificial Sequence: Synthetic oligonucleotide
  modified_base (15)..(15): a, c, u, g, unknown or other
cguggacuggauucn

SEQ ID NO: 1581 - RNA, 15 nt, Artificial Sequence
  Description of Artificial Sequence: Synthetic oligonucleotide
  modified_base (15)..(15): a, c, u, g, unknown or other
agaaaucuuugucun

SEQ ID NO: 1582 - RNA, 15 nt, Artificial Sequence
  Description of Artificial Sequence: Synthetic oligonucleotide
  modified_base (15)..(15): a, c, u, g, unknown or other
cacugaaauccugun

SEQ ID NO: 1583 - RNA, 15 nt, Artificial Sequence
  Description of Artificial Sequence: Synthetic oligonucleotide
  modified_base (15)..(15): a, c, u, g, unknown or other
gauauugccuuguun

SEQ ID NO: 1584 - RNA, 15 nt, Artificial Sequence
  Description of Artificial Sequence: Synthetic oligonucleotide
  modified_base (15)..(15): a, c, u, g, unknown or other
uaugauauugccuun

SEQ ID NO: 1585 - RNA, 15 nt, Artificial Sequence
  Description of Artificial Sequence: Synthetic oligonucleotide
  modified_base (15)..(15): a, c, u, g, unknown or other
cgauuucuggguaun

SEQ ID NO: 1586 - RNA, 15 nt, Artificial Sequence
  Description of Artificial Sequence: Synthetic oligonucleotide
  modified_base (15)..(15): a, c, u, g, unknown or other
auuuuaaaucaaucn

SEQ ID NO: 1587 - RNA, 15 nt, Artificial Sequence
  Description of Artificial Sequence: Synthetic oligonucleotide
  modified_base (15)..(15): a, c, u, g, unknown or other
caagagugaauaggn

SEQ ID NO: 1588 - RNA, 15 nt, Artificial Sequence
  Description of Artificial Sequence: Synthetic oligonucleotide
  modified_base (15)..(15): a, c, u, g, unknown or other
uuuugcgugucuacn

SEQ ID NO: 1589 - RNA, 15 nt, Artificial Sequence
  Description of Artificial Sequence: Synthetic oligonucleotide
  modified_base (15)..(15): a, c, u, g, unknown or other
cuggagaaaacucan

SEQ ID NO: 1590 - RNA, 15 nt, Artificial Sequence
  Description of Artificial Sequence: Synthetic oligonucleotide
  modified_base (15)..(15): a, c, u, g, unknown or other
aaucucaaagaaaun

SEQ ID NO: 1591 - RNA, 15 nt, Artificial Sequence
  Description of Artificial Sequence: Synthetic oligonucleotide
  modified_base (15)..(15): a, c, u, g, unknown or other
augauuuucuuauan

SEQ ID NO: 1592 - RNA, 15 nt, Artificial Sequence
  Description of Artificial Sequence: Synthetic oligonucleotide
  modified_base (15)..(15): a, c, u, g, unknown or other
ucaccuaagauuuun

SEQ ID NO: 1593 - RNA, 15 nt, Artificial Sequence
  Description of Artificial Sequence: Synthetic oligonucleotide
  modified_base (15)..(15): a, c, u, g, unknown or other
cagcaucccagugun

SEQ ID NO: 1594 - RNA, 15 nt, Artificial Sequence
  Description of Artificial Sequence: Synthetic oligonucleotide
  modified_base (15)..(15): a, c, u, g, unknown or other
ugaaauccugugcan

SEQ ID NO: 1595 - RNA, 15 nt, Artificial Sequence
  Description of Artificial Sequence: Synthetic oligonucleotide
  modified_base (15)..(15): a, c, u, g, unknown or other
aaucuggcuuguaun

SEQ ID NO: 1596 - RNA, 15 nt, Artificial Sequence
  Description of Artificial Sequence: Synthetic oligonucleotide
  modified_base (15)..(15): a, c, u, g, unknown or other
aacuggaaaccacan

SEQ ID NO: 1597 - RNA, 15 nt, Artificial Sequence
  Description of Artificial Sequence: Synthetic oligonucleotide
  modified_base (15)..(15): a, c, u, g, unknown or other
cgaagggaagggcan

SEQ ID NO: 1598 - RNA, 15 nt, Artificial Sequence
  Description of Artificial Sequence: Synthetic oligonucleotide
  modified_base (15)..(15): a, c, u, g, unknown or other
uucaggaugauuuun

SEQ ID NO: 1599 - RNA, 15 nt, Artificial Sequence
  Description of Artificial Sequence: Synthetic oligonucleotide
  modified_base (15)..(15): a, c, u, g, unknown or other
cacugauuucuuggn

SEQ ID NO: 1600 - RNA, 15 nt, Artificial Sequence
  Description of Artificial Sequence: Synthetic oligonucleotide
  modified_base (15)..(15): a, c, u, g, unknown or other
acgacccauaugccn

SEQ ID NO: 1601 - RNA, 15 nt, Artificial Sequence
  Description of Artificial Sequence: Synthetic oligonucleotide
  modified_base (15)..(15): a, c, u, g, unknown or other
auuacacagauucun

SEQ ID NO: 1602 - RNA, 15 nt, Artificial Sequence
  Description of Artificial Sequence: Synthetic oligonucleotide
  modified_base (15)..(15): a, c, u, g, unknown or other
uacguggacuggaun

SEQ ID NO: 1603 - RNA, 15 nt, Artificial Sequence
  Description of Artificial Sequence: Synthetic oligonucleotide
  modified_base (15)..(15): a, c, u, g, unknown or other
aagagauacagaggn

SEQ ID NO: 1604 - RNA, 15 nt, Artificial Sequence
  Description of Artificial Sequence: Synthetic oligonucleotide
  modified_base (15)..(15): a, c, u, g, unknown or other
cugaaauccugugcn

SEQ ID NO: 1605 - RNA, 15 nt, Artificial Sequence
  Description of Artificial Sequence: Synthetic oligonucleotide
  modified_base (15)..(15): a, c, u, g, unknown or other
auucuucauuuuacn

SEQ ID NO: 1606 - RNA, 15 nt, Artificial Sequence
  Description of Artificial Sequence: Synthetic oligonucleotide
  modified_base (15)..(15): a, c, u, g, unknown or other
agauucucaacgacn

SEQ ID NO: 1607 - RNA, 15 nt, Artificial Sequence
  Description of Artificial Sequence: Synthetic oligonucleotide
  modified_base (15)..(15): a, c, u, g, unknown or other
cuggauauuguugcn

SEQ ID NO: 1608 - RNA, 15 nt, Artificial Sequence
  Description of Artificial Sequence: Synthetic oligonucleotide
  modified_base (15)..(15): a, c, u, g, unknown or other
aaugccguccgcugn

SEQ ID NO: 1609 - RNA, 15 nt, Artificial Sequence
  Description of Artificial Sequence: Synthetic oligonucleotide
  modified_base (15)..(15): a, c, u, g, unknown or other
uacuuaaagcuuucn

SEQ ID NO: 1610 - RNA, 15 nt, Artificial Sequence
  Description of Artificial Sequence: Synthetic oligonucleotide
  modified_base (15)..(15): a, c, u, g, unknown or other
uacagaaacacugcn

SEQ ID NO: 1611 - RNA, 15 nt, Artificial Sequence
  Description of Artificial Sequence: Synthetic oligonucleotide
  modified_base (15)..(15): a, c, u, g, unknown or other
uuacacagauucucn

SEQ ID NO: 1612 - RNA, 15 nt, Artificial Sequence
  Description of Artificial Sequence: Synthetic oligonucleotide
  modified_base (15)..(15): a, c, u, g, unknown or other
guacguggacuggan

SEQ ID NO: 1613 - RNA, 15 nt, Artificial Sequence
  Description of Artificial Sequence: Synthetic oligonucleotide
  modified_base (15)..(15): a, c, u, g, unknown or other
aagcaaugcucacan

SEQ ID NO: 1614 - RNA, 15 nt, Artificial Sequence
  Description of Artificial Sequence: Synthetic oligonucleotide
  modified_base (15)..(15): a, c, u, g, unknown or other
acucaucaucccggn

SEQ ID NO: 1615 - RNA, 15 nt, Artificial Sequence
  Description of Artificial Sequence: Synthetic oligonucleotide
  modified_base (15)..(15): a, c, u, g, unknown or other
gcucgauaaaguggn

SEQ ID NO: 1616 - RNA, 15 nt, Artificial Sequence
  Description of Artificial Sequence: Synthetic oligonucleotide
  modified_base (15)..(15): a, c, u, g, unknown or other
uaaaauggauaaugn

SEQ ID NO: 1617 - RNA, 15 nt, Artificial Sequence
  Description of Artificial Sequence: Synthetic oligonucleotide
  modified_base (15)..(15): a, c, u, g, unknown or other
ucaucaucccgguun

SEQ ID NO: 1618 - RNA, 15 nt, Artificial Sequence
  Description of Artificial Sequence: Synthetic oligonucleotide
  modified_base (15)..(15): a, c, u, g, unknown or other
aauggcccaaagaan

SEQ ID NO: 1619 - RNA, 15 nt, Artificial Sequence
  Description of Artificial Sequence: Synthetic oligonucleotide
  modified_base (15)..(15): a, c, u, g, unknown or other
caagauacccuuagn

SEQ ID NO: 1620 - RNA, 15 nt, Artificial Sequence
  Description of Artificial Sequence: Synthetic oligonucleotide
  modified_base (15)..(15): a, c, u, g, unknown or other
aaugcucacaccaan

SEQ ID NO: 1621 - RNA, 15 nt, Artificial Sequence
  Description of Artificial Sequence: Synthetic oligonucleotide
  modified_base (15)..(15): a, c, u, g, unknown or other
caacgacccauaugn

SEQ ID NO: 1622 - RNA, 15 nt, Artificial Sequence
  Description of Artificial Sequence: Synthetic oligonucleotide
  modified_base (15)..(15): a, c, u, g, unknown or other
uggauacacauuaan

SEQ ID NO: 1623 - RNA, 15 nt, Artificial Sequence
  Description of Artificial Sequence: Synthetic oligonucleotide
  modified_base (15)..(15): a, c, u, g, unknown or other
cuuaaaacaucugan

SEQ ID NO: 1624 - RNA, 15 nt, Artificial Sequence
  Description of Artificial Sequence: Synthetic oligonucleotide
  modified_base (15)..(15): a, c, u, g, unknown or other
cuccaucauuggaan

SEQ ID NO: 1625 - RNA, 15 nt, Artificial Sequence
  Description of Artificial Sequence: Synthetic oligonucleotide
  modified_base (15)..(15): a, c, u, g, unknown or other
guggacuggauucun

SEQ ID NO: 1626 - RNA, 15 nt, Artificial Sequence
  Description of Artificial Sequence: Synthetic oligonucleotide
  modified_base (15)..(15): a, c, u, g, unknown or other
caaagaaucucaaan

SEQ ID NO: 1627 - RNA, 15 nt, Artificial Sequence
  Description of Artificial Sequence: Synthetic oligonucleotide
  modified_base (15)..(15): a, c, u, g, unknown or other
uuuucaggaugauun

SEQ ID NO: 1628 - RNA, 15 nt, Artificial Sequence
  Description of Artificial Sequence: Synthetic oligonucleotide
  modified_base (15)..(15): a, c, u, g, unknown or other
gauuuugcgugucun

SEQ ID NO: 1629 - RNA, 15 nt, Artificial Sequence
  Description of Artificial Sequence: Synthetic oligonucleotide
  modified_base (15)..(15): a, c, u, g, unknown or other
cguggucgaguacgn

SEQ ID NO: 1630 - RNA, 15 nt, Artificial Sequence
  Description of Artificial Sequence: Synthetic oligonucleotide
  modified_base (15)..(15): a, c, u, g, unknown or other
ugggugacuggaugn

SEQ ID NO: 1631 - RNA, 15 nt, Artificial Sequence
  Description of Artificial Sequence: Synthetic oligonucleotide
  modified_base (15)..(15): a, c, u, g, unknown or other
agcaucccaguguun

SEQ ID NO: 1632 - RNA, 15 nt, Artificial Sequence
  Description of Artificial Sequence: Synthetic oligonucleotide
  modified_base (15)..(15): a, c, u, g, unknown or other
caaagcucuuucugn

SEQ ID NO: 1633 - RNA, 15 nt, Artificial Sequence
  Description of Artificial Sequence: Synthetic oligonucleotide
  modified_base (15)..(15): a, c, u, g, unknown or other
agaaucucaaagaan

SEQ ID NO: 1634 - RNA, 15 nt, Artificial Sequence
  Description of Artificial Sequence: Synthetic oligonucleotide
  modified_base (15)..(15): a, c, u, g, unknown or other
uggauauuguugcun

SEQ ID NO: 1635 - RNA, 15 nt, Artificial Sequence
  Description of Artificial Sequence: Synthetic oligonucleotide
  modified_base (15)..(15): a, c, u, g, unknown or other
cucgauaaaguggun

SEQ ID NO: 1636 - RNA, 15 nt, Artificial Sequence
  Description of Artificial Sequence: Synthetic oligonucleotide
  modified_base (15)..(15): a, c, u, g, unknown or other
aacgaagggaagggn

SEQ ID NO: 1637 - RNA, 15 nt, Artificial Sequence
  Description of Artificial Sequence: Synthetic oligonucleotide
  modified_base (15)..(15): a, c, u, g, unknown or other
ccuaagauuuugcgn

SEQ ID NO: 1638 - RNA, 15 nt, Artificial Sequence
  Description of Artificial Sequence: Synthetic oligonucleotide
  modified_base (15)..(15): a, c, u, g, unknown or other
cacaguaacacgcun

SEQ ID NO: 1639 - RNA, 15 nt, Artificial Sequence
  Description of Artificial Sequence: Synthetic oligonucleotide
  modified_base (15)..(15): a, c, u, g, unknown or other
cuacagggaaggagn

SEQ ID NO: 1640 - RNA, 15 nt, Artificial Sequence
  Description of Artificial Sequence: Synthetic oligonucleotide
  modified_base (15)..(15): a, c, u, g, unknown or other
gagauacagaggacn

SEQ ID NO: 1641 - RNA, 15 nt, Artificial Sequence
  Description of Artificial Sequence: Synthetic oligonucleotide
  modified_base (15)..(15): a, c, u, g, unknown or other
gaaagccaagauacn

SEQ ID NO: 1642 - RNA, 15 nt, Artificial Sequence
  Description of Artificial Sequence: Synthetic oligonucleotide
  modified_base (15)..(15): a, c, u, g, unknown or other
aacacugccaagagn

SEQ ID NO: 1643 - RNA, 15 nt, Artificial Sequence
  Description of Artificial Sequence: Synthetic oligonucleotide
  modified_base (15)..(15): a, c, u, g, unknown or other
augacacugauuucn

SEQ ID NO: 1644 - RNA, 15 nt, Artificial Sequence
  Description of Artificial Sequence: Synthetic oligonucleotide
  modified_base (15)..(15): a, c, u, g, unknown or other
cggcuacagggaagn

SEQ ID NO: 1645 - RNA, 15 nt, Artificial Sequence
  Description of Artificial Sequence: Synthetic oligonucleotide
  modified_base (15)..(15): a, c, u, g, unknown or other
aagggagcggccagn

SEQ ID NO: 1646 - RNA, 15 nt, Artificial Sequence
  Description of Artificial Sequence: Synthetic oligonucleotide
  modified_base (15)..(15): a, c, u, g, unknown or other
uaagauuuugcgugn

SEQ ID NO: 1647 - RNA, 15 nt, Artificial Sequence
  Description of Artificial Sequence: Synthetic oligonucleotide
  modified_base (15)..(15): a, c, u, g, unknown or other
cucuuucugguuucn

SEQ ID NO: 1648 - RNA, 15 nt, Artificial Sequence
  Description of Artificial Sequence: Synthetic oligonucleotide
  modified_base (15)..(15): a, c, u, g, unknown or other
uuacuuaaagcuuun

SEQ ID NO: 1649 - RNA, 15 nt, Artificial Sequence
  Description of Artificial Sequence: Synthetic oligonucleotide
  modified_base (15)..(15): a, c, u, g, unknown or other
cuaaucuggcuugun

SEQ ID NO: 1650 - RNA, 15 nt, Artificial Sequence
  Description of Artificial Sequence: Synthetic oligonucleotide
  modified_base (15)..(15): a, c, u, g, unknown or other
aauggauaaugagun

SEQ ID NO: 1651 - RNA, 15 nt, Artificial Sequence
  Description of Artificial Sequence: Synthetic oligonucleotide
  modified_base (15)..(15): a, c, u, g, unknown or other
aaggucuuuucaggn

SEQ ID NO: 1652 - RNA, 15 nt, Artificial Sequence
  Description of Artificial Sequence: Synthetic oligonucleotide
  modified_base (15)..(15): a, c, u, g, unknown or other
caucauuggaaaccn

SEQ ID NO: 1653 - RNA, 15 nt, Artificial Sequence
  Description of Artificial Sequence: Synthetic oligonucleotide
  modified_base (15)..(15): a, c, u, g, unknown or other
ccugccagaaacugn

SEQ ID NO: 1654 - RNA, 15 nt, Artificial Sequence
  Description of Artificial Sequence: Synthetic oligonucleotide
  modified_base (15)..(15): a, c, u, g, unknown or other
caguguucugccaun

SEQ ID NO: 1655 - RNA, 15 nt, Artificial Sequence
  Description of Artificial Sequence: Synthetic oligonucleotide
  modified_base (15)..(15): a, c, u, g, unknown or other
ucucaaagaaaucun

SEQ ID NO: 1656 - RNA, 15 nt, Artificial Sequence
  Description of Artificial Sequence: Synthetic oligonucleotide
  modified_base (15)..(15): a, c, u, g, unknown or other
uugaaacuggaaacn

SEQ ID NO: 1657 - RNA, 15 nt, Artificial Sequence
  Description of Artificial Sequence: Synthetic oligonucleotide
  modified_base (15)..(15): a, c, u, g, unknown or other
agagauacagaggan

SEQ ID NO: 1658 - RNA, 15 nt, Artificial Sequence
  Description of Artificial Sequence: Synthetic oligonucleotide
  modified_base (15)..(15): a, c, u, g, unknown or other
gucuuuucaggaugn

SEQ ID NO: 1659 - RNA, 15 nt, Artificial Sequence
  Description of Artificial Sequence: Synthetic oligonucleotide
  modified_base (15)..(15): a, c, u, g, unknown or other
uggagaaaacucaan

SEQ ID NO: 1660 - RNA, 15 nt, Artificial Sequence
  Description of Artificial Sequence: Synthetic oligonucleotide
  modified_base (15)..(15): a, c, u, g, unknown or other
aaccacagugaauun

SEQ ID NO: 1661 - RNA, 15 nt, Artificial Sequence
  Description of Artificial Sequence: Synthetic oligonucleotide
  modified_base (15)..(15): a, c, u, g, unknown or other
cucaaagaaaucuun

SEQ ID NO: 1662 - RNA, 15 nt, Artificial Sequence
  Description of Artificial Sequence: Synthetic oligonucleotide
  modified_base (15)..(15): a, c, u, g, unknown or other
aaaucuuugucuccn

SEQ ID NO: 1663 - RNA, 15 nt, Artificial Sequence
  Description of Artificial Sequence: Synthetic oligonucleotide
  modified_base (15)..(15): a, c, u, g, unknown or other
ucaggaugauuuucn

SEQ ID NO: 1664 - RNA, 15 nt, Artificial Sequence
  Description of Artificial Sequence: Synthetic oligonucleotide
  modified_base (15)..(15): a, c, u, g, unknown or other
aaaauggcagaaagn

SEQ ID NO: 1665 - RNA, 15 nt, Artificial Sequence
  Description of Artificial Sequence: Synthetic oligonucleotide
  modified_base (15)..(15): a, c, u, g, unknown or other
cgaguacguggacun

SEQ ID NO: 1666 - RNA, 15 nt, Artificial Sequence
  Description of Artificial Sequence: Synthetic oligonucleotide
  modified_base (15)..(15): a, c, u, g, unknown or other
aguacacgcauuaan

SEQ ID NO: 1667 - RNA, 15 nt, Artificial Sequence
  Description of Artificial Sequence: Synthetic oligonucleotide
  modified_base (15)..(15): a, c, u, g, unknown or other
cuggauacacauuan

SEQ ID NO: 1668 - RNA, 15 nt, Artificial Sequence
  Description of Artificial Sequence: Synthetic oligonucleotide
  modified_base (15)..(15): a, c, u, g, unknown or other
uggcccaaagaaucn

SEQ ID NO: 1669 - RNA, 15 nt, Artificial Sequence
  Description of Artificial Sequence: Synthetic oligonucleotide
  modified_base (15)..(15): a, c, u, g, unknown or other
ucuuucugguuucan

SEQ ID NO: 1670 - RNA, 15 nt, Artificial Sequence
  Description of Artificial Sequence: Synthetic oligonucleotide
  modified_base (15)..(15): a, c, u, g, unknown or other
cuggugaaugugugn

SEQ ID NO: 1671 - RNA, 15 nt, Artificial Sequence
  Description of Artificial Sequence: Synthetic oligonucleotide
  modified_base (15)..(15): a, c, u, g, unknown or other
aaagaaaucuuugun

SEQ ID NO: 1672 - RNA, 15 nt, Artificial Sequence
  Description of Artificial Sequence: Synthetic oligonucleotide
  modified_base (15)..(15): a, c, u, g, unknown or other
aggagauagaaaugn

SEQ ID NO: 1673 - RNA, 15 nt, Artificial Sequence
  Description of Artificial Sequence: Synthetic oligonucleotide
  modified_base (15)..(15): a, c, u, g, unknown or other
caguguuacagaaan

SEQ ID NO: 1674 - RNA, 15 nt, Artificial Sequence
  Description of Artificial Sequence: Synthetic oligonucleotide
  modified_base (15)..(15): a, c, u, g, unknown or other
uuucacugaaauccn

SEQ ID NO: 1675 - RNA, 15 nt, Artificial Sequence
  Description of Artificial Sequence: Synthetic oligonucleotide
  modified_base (15)..(15): a, c, u, g, unknown or other
gcucaaagggagcgn

SEQ ID NO: 1676 - RNA, 15 nt, Artificial Sequence
  Description of Artificial Sequence: Synthetic oligonucleotide
  modified_base (15)..(15): a, c, u, g, unknown or other
gaguacguggacugn

SEQ ID NO: 1677 - RNA, 15 nt, Artificial Sequence
  Description of Artificial Sequence: Synthetic oligonucleotide
  modified_base (15)..(15): a, c, u, g, unknown or other
cgacccauaugccun

SEQ ID NO: 1678 - RNA, 15 nt, Artificial Sequence
  Description of Artificial Sequence: Synthetic oligonucleotide
  modified_base (15)..(15): a, c, u, g, unknown or other
gauacagaggacaun

SEQ ID NO: 1679 - RNA, 15 nt, Artificial Sequence
  Description of Artificial Sequence: Synthetic oligonucleotide
  modified_base (15)..(15): a, c, u, g, unknown or other
caccaaaaucaagcn

SEQ ID NO: 1680 - RNA, 15 nt, Artificial Sequence
  Description of Artificial Sequence: Synthetic oligonucleotide
  modified_base (15)..(15): a, c, u, g, unknown or other
ggaggcuccaucaun

SEQ ID NO: 1681 - RNA, 15 nt, Artificial Sequence
  Description of Artificial Sequence: Synthetic oligonucleotide
  modified_base (15)..(15): a, c, u, g, unknown or other
cagauucucaacgan

SEQ ID NO: 1682 - RNA, 15 nt, Artificial Sequence
  Description of Artificial Sequence: Synthetic oligonucleotide
  modified_base (15)..(15): a, c, u, g, unknown or other
uguaaaauggauaan

SEQ ID NO: 1683 - RNA, 15 nt, Artificial Sequence
  Description of Artificial Sequence: Synthetic oligonucleotide
  modified_base (15)..(15): a, c, u, g, unknown or other
gagugaauaggacan

SEQ ID NO: 1684 - RNA, 15 nt, Artificial Sequence
  Description of Artificial Sequence: Synthetic oligonucleotide
  modified_base (15)..(15): a, c, u, g, unknown or other
agaacuggauauugn

SEQ ID NO: 1685 - RNA, 15 nt, Artificial Sequence
  Description of Artificial Sequence: Synthetic oligonucleotide
  modified_base (15)..(15): a, c, u, g, unknown or other
aaagaaucucaaagn

SEQ ID NO: 1686 - RNA, 15 nt, Artificial Sequence
  Description of Artificial Sequence: Synthetic oligonucleotide
  modified_base (15)..(15): a, c, u, g, unknown or other
cacugccaagagugn

SEQ ID NO: 1687 - RNA, 15 nt, Artificial Sequence
  Description of Artificial Sequence: Synthetic oligonucleotide
  modified_base (15)..(15): a, c, u, g, unknown or other
gguauucuuucaagn

SEQ ID NO: 1688 - RNA, 15 nt, Artificial Sequence
  Description of Artificial Sequence: Synthetic oligonucleotide
  modified_base (15)..(15): a, c, u, g, unknown or other
guaugauauugccun

SEQ ID NO: 1689 - RNA, 15 nt, Artificial Sequence
  Description of Artificial Sequence: Synthetic oligonucleotide
  modified_base (15)..(15): a, c, u, g, unknown or other
agugaauuacacagn

SEQ ID NO: 1690 - RNA, 15 nt, Artificial Sequence
  Description of Artificial Sequence: Synthetic oligonucleotide
  modified_base (15)..(15): a, c, u, g, unknown or other
aaccaguggauauun

SEQ ID NO: 1691 - RNA, 15 nt, Artificial Sequence
  Description of Artificial Sequence: Synthetic oligonucleotide
  modified_base (15)..(15): a, c, u, g, unknown or other
uggguauucuuucan

SEQ ID NO: 1692 - RNA, 15 nt, Artificial Sequence
  Description of Artificial Sequence: Synthetic oligonucleotide
  modified_base (15)..(15): a, c, u, g, unknown or other
caguggauauuaacn

SEQ ID NO: 1693 - RNA, 15 nt, Artificial Sequence
  Description of Artificial Sequence: Synthetic oligonucleotide
  modified_base (15)..(15): a, c, u, g, unknown or other
auuuuaccaugacan

SEQ ID NO: 1694 - RNA, 15 nt, Artificial Sequence
  Description of Artificial Sequence: Synthetic oligonucleotide
  modified_base (15)..(15): a, c, u, g, unknown or other
auggcccaaagaaun

SEQ ID NO: 1695 - RNA, 15 nt, Artificial Sequence
  Description of Artificial Sequence: Synthetic oligonucleotide
  modified_base (15)..(15): a, c, u, g, unknown or other
cguuggaggaacugn

SEQ ID NO: 1696 - RNA, 15 nt, Artificial Sequence
  Description of Artificial Sequence: Synthetic oligonucleotide
  modified_base (15)..(15): a, c, u, g, unknown or other
acugaagcacacccn

SEQ ID NO: 1697 - RNA, 15 nt, Artificial Sequence
  Description of Artificial Sequence: Synthetic oligonucleotide
  modified_base (15)..(15): a, c, u, g, unknown or other
uuaaagcuuucuucn

SEQ ID NO: 1698 - RNA, 15 nt, Artificial Sequence
  Description of Artificial Sequence: Synthetic oligonucleotide
  modified_base (15)..(15): a, c, u, g, unknown or other
ggucuuuucaggaun

SEQ ID NO: 1699 - RNA, 15 nt, Artificial Sequence
  Description of Artificial Sequence: Synthetic oligonucleotide
  modified_base (15)..(15): a, c, u, g, unknown or other
acuuaaagcuuucun

SEQ ID NO: 1700 - RNA, 15 nt, Artificial Sequence
  Description of Artificial Sequence: Synthetic oligonucleotide
  modified_base (15)..(15): a, c, u, g, unknown or other
uuacagaaacacugn

SEQ ID NO: 1701 - RNA, 15 nt, Artificial Sequence
  Description of Artificial Sequence: Synthetic oligonucleotide
  modified_base (15)..(15): a, c, u, g, unknown or other
agauuuugcgugucn

SEQ ID NO: 1702 - RNA, 15 nt, Artificial Sequence
  Description of Artificial Sequence: Synthetic oligonucleotide
  modified_base (15)..(15): a, c, u, g, unknown or other
agcaaugcucacacn

SEQ ID NO: 1703 - RNA, 15 nt, Artificial Sequence
  Description of Artificial Sequence: Synthetic oligonucleotide
  modified_base (15)..(15): a, c, u, g, unknown or other
aagcucuuucuggun

SEQ ID NO: 1704 - RNA, 15 nt, Artificial Sequence
  Description of Artificial Sequence: Synthetic oligonucleotide
  modified_base (15)..(15): a, c, u, g, unknown or other
ccugugcacuuucun

SEQ ID NO: 1705 - RNA, 15 nt, Artificial Sequence
  Description of Artificial Sequence: Synthetic oligonucleotide
  modified_base (15)..(15): a, c, u, g, unknown or other
caaucugaaauaaan

SEQ ID NO: 1706 - RNA, 15 nt, Artificial Sequence
  Description of Artificial Sequence: Synthetic oligonucleotide
  modified_base (15)..(15): a, c, u, g, unknown or other
agaagaacuggauan

SEQ ID NO: 1707 - RNA, 15 nt, Artificial Sequence
  Description of Artificial Sequence: Synthetic oligonucleotide
  modified_base (15)..(15): a, c, u, g, unknown or other
cuucacuuucacggn

SEQ ID NO: 1708 - RNA, 15 nt, Artificial Sequence
  Description of Artificial Sequence: Synthetic oligonucleotide
  modified_base (15)..(15): a, c, u, g, unknown or other
uacugaagcacaccn

SEQ ID NO: 1709 - RNA, 15 nt, Artificial Sequence
  Description of Artificial Sequence: Synthetic oligonucleotide
  modified_base (15)..(15): a, c, u, g, unknown or other
gaggcccucuguccn

SEQ ID NO: 1710 - RNA, 15 nt, Artificial Sequence
  Description of Artificial Sequence: Synthetic oligonucleotide
  modified_base (15)..(15): a, c, u, g, unknown or other
aggaugauuuucuun

SEQ ID NO: 1711 - RNA, 15 nt, Artificial Sequence
  Description of Artificial Sequence: Synthetic oligonucleotide
  modified_base (15)..(15): a, c, u, g, unknown or other
cccaaagaaucucan

SEQ ID NO: 1712 - RNA, 15 nt, Artificial Sequence
  Description of Artificial Sequence: Synthetic oligonucleotide
  modified_base (15)..(15): a, c, u, g, unknown or other
ucuccuuaaaacaun

SEQ ID NO: 1713 - RNA, 15 nt, Artificial Sequence
  Description of Artificial Sequence: Synthetic oligonucleotide
  modified_base (15)..(15): a, c, u, g, unknown or other
ugccagaaacugugn

SEQ ID NO: 1714 - RNA, 15 nt, Artificial Sequence
  Description of Artificial Sequence: Synthetic oligonucleotide
  modified_base (15)..(15): a, c, u, g, unknown or other
gaacuggauauugun

SEQ ID NO: 1715 - RNA, 15 nt, Artificial Sequence
  Description of Artificial Sequence: Synthetic oligonucleotide
  modified_base (15)..(15): a, c, u, g, unknown or other
uuucuggugaaugun

SEQ ID NO: 1716 - RNA, 15 nt, Artificial Sequence
  Description of Artificial Sequence: Synthetic oligonucleotide
  modified_base (15)..(15): a, c, u, g, unknown or other
augauauugccuugn

SEQ ID NO: 1717 - RNA, 15 nt, Artificial Sequence
  Description of Artificial Sequence: Synthetic oligonucleotide
  modified_base (15)..(15): a, c, u, g, unknown or other
caggaucguuggagn

SEQ ID NO: 1718 - RNA, 15 nt, Artificial Sequence
  Description of Artificial Sequence: Synthetic oligonucleotide
  modified_base (15)..(15): a, c, u, g, unknown or other
cuuucugguuucagn

SEQ ID NO: 1719 - RNA, 15 nt, Artificial Sequence
  Description of Artificial Sequence: Synthetic oligonucleotide
  modified_base (15)..(15): a, c, u, g, unknown or other
uugcaagggagauun

SEQ ID NO: 1720 - RNA, 15 nt, Artificial Sequence
  Description of Artificial Sequence: Synthetic oligonucleotide
  modified_base (15)..(15): a, c, u, g, unknown or other
cagugaauuacacan

SEQ ID NO: 1721 - RNA, 15 nt, Artificial Sequence
  Description of Artificial Sequence: Synthetic oligonucleotide
  modified_base (15)..(15): a, c, u, g, unknown or other
gauuuucacugaaan

SEQ ID NO: 1722 - RNA, 15 nt, Artificial Sequence
  Description of Artificial Sequence: Synthetic oligonucleotide
  modified_base (15)..(15): a, c, u, g, unknown or other
uuucaggaugauuun

SEQ ID NO: 1723 - RNA, 15 nt, Artificial Sequence
  Description of Artificial Sequence: Synthetic oligonucleotide
  modified_base (15)..(15): a, c, u, g, unknown or other
ggauaaugaguguan

SEQ ID NO: 1724 - RNA, 15 nt, Artificial Sequence
  Description of Artificial Sequence: Synthetic oligonucleotide
  modified_base (15)..(15): a, c, u, g, unknown or other
agaaacacugccaan

SEQ ID NO: 1725 - RNA, 15 nt, Artificial Sequence
  Description of Artificial Sequence: Synthetic oligonucleotide
  modified_base (15)..(15): a, c, u, g, unknown or other
auaaugaguguaccn

SEQ ID NO: 1726 - RNA, 15 nt, Artificial Sequence
  Description of Artificial Sequence: Synthetic oligonucleotide
  modified_base (15)..(15): a, c, u, g, unknown or other
ccauaugccugccun

SEQ ID NO: 1727 - RNA, 15 nt, Artificial Sequence
  Description of Artificial Sequence: Synthetic oligonucleotide
  modified_base (15)..(15): a, c, u, g, unknown or other
cuuguugaaacuggn

SEQ ID NO: 1728 - RNA, 15 nt, Artificial Sequence
  Description of Artificial Sequence: Synthetic oligonucleotide
  modified_base (15)..(15): a, c, u, g, unknown or other
aaagggagcggccan

SEQ ID NO: 1729 - RNA, 15 nt, Artificial Sequence
  Description of Artificial Sequence: Synthetic oligonucleotide
  modified_base (15)..(15): a, c, u, g, unknown or other
cuggaaaccacagun

SEQ ID NO: 1730 - RNA, 15 nt, Artificial Sequence
  Description of Artificial Sequence: Synthetic oligonucleotide
  modified_base (15)..(15): a, c, u, g, unknown or other
ggaauggcccaaagn

SEQ ID NO: 1731 - RNA, 15 nt, Artificial Sequence
  Description of Artificial Sequence: Synthetic oligonucleotide
  modified_base (15)..(15): a, c, u, g, unknown or other
ggaugauuuucuuan

SEQ ID NO: 1732 - RNA, 15 nt, Artificial Sequence
  Description of Artificial Sequence: Synthetic oligonucleotide
  modified_base (15)..(15): a, c, u, g, unknown or other
cugaaauaaaagagn

SEQ ID NO: 1733 - RNA, 15 nt, Artificial Sequence
  Description of Artificial Sequence: Synthetic oligonucleotide
  modified_base (15)..(15): a, c, u, g, unknown or other
aagaaucucaaagan

SEQ ID NO: 1734 - RNA, 15 nt, Artificial Sequence
  Description of Artificial Sequence: Synthetic oligonucleotide
  modified_base (15)..(15): a, c, u, g, unknown or other
gaggcuccaucauun

SEQ ID NO: 1735 - RNA, 15 nt, Artificial Sequence
  Description of Artificial Sequence: Synthetic oligonucleotide
  modified_base (15)..(15): a, c, u, g, unknown or other
uucugccauucuucn

SEQ ID NO: 1736 - RNA, 15 nt, Artificial Sequence
  Description of Artificial Sequence: Synthetic oligonucleotide
  modified_base (15)..(15): a, c, u, g, unknown or other
aggcuccaucauugn

SEQ ID NO: 1737 - RNA, 15 nt, Artificial Sequence
  Description of Artificial Sequence: Synthetic oligonucleotide
  modified_base (15)..(15): a, c, u, g, unknown or other
uguggaggcuccaun

SEQ ID NO: 1738 - RNA, 15 nt, Artificial Sequence
  Description of Artificial Sequence: Synthetic oligonucleotide
  modified_base (15)..(15): a, c, u, g, unknown or other
acugauuucuugggn

SEQ ID NO: 1739 - RNA, 15 nt, Artificial Sequence
  Description of Artificial Sequence: Synthetic oligonucleotide
  modified_base (15)..(15): a, c, u, g, unknown or other
cuguguggaggcucn

SEQ ID NO: 1740 - RNA, 15 nt, Artificial Sequence
  Description of Artificial Sequence: Synthetic oligonucleotide
  modified_base (15)..(15): a, c, u, g, unknown or other
ugauuucuugggagn

SEQ ID NO: 1741 - RNA, 15 nt, Artificial Sequence
  Description of Artificial Sequence: Synthetic oligonucleotide
  modified_base (15)..(15): a, c, u, g, unknown or other
caccuguguggaggn

SEQ ID NO: 1742 - RNA, 15 nt, Artificial Sequence
  Description of Artificial Sequence: Synthetic oligonucleotide
  modified_base (15)..(15): a, c, u, g, unknown or other
ggcuccaucauuggn

SEQ ID NO: 1743 - RNA, 15 nt, Artificial Sequence
  Description of Artificial Sequence: Synthetic oligonucleotide
  modified_base (15)..(15): a, c, u, g, unknown or other
uccaucauuggaaan

SEQ ID NO: 1744 - RNA, 15 nt, Artificial Sequence
  Description of Artificial Sequence: Synthetic oligonucleotide
  modified_base (15)..(15): a, c, u, g, unknown or other
cugauuucuugggan

SEQ ID NO: 1745 - RNA, 15 nt, Artificial Sequence
  Description of Artificial Sequence: Synthetic oligonucleotide
  modified_base (15)..(15): a, c, u, g, unknown or other
ccuguguggaggcun

SEQ ID NO: 1746 - RNA, 15 nt, Artificial Sequence
  Description of Artificial Sequence: Synthetic oligonucleotide
  modified_base (15)..(15): a, c, u, g, unknown or other
uucuugggagaagan

SEQ ID NO: 1747 - RNA, 15 nt, Artificial Sequence
  Description of Artificial Sequence: Synthetic oligonucleotide
  modified_base (15)..(15): a, c, u, g, unknown or other
ccaucauuggaaacn

SEQ ID NO: 1748 - RNA, 15 nt, Artificial Sequence
  Description of Artificial Sequence: Synthetic oligonucleotide
  modified_base (15)..(15): a, c, u, g, unknown or other
gcuccaucauuggan

SEQ ID NO: 1749 - RNA, 15 nt, Artificial Sequence
  Description of Artificial Sequence: Synthetic oligonucleotide
  modified_base (15)..(15): a, c, u, g, unknown or other
guguggaggcuccan

SEQ ID NO: 1750 - RNA, 15 nt, Artificial Sequence
  Description of Artificial Sequence: Synthetic oligonucleotide
  modified_base (15)..(15): a, c, u, g, unknown or other
accuguguggaggcn

SEQ ID NO: 1751 - RNA, 19 nt, Artificial Sequence
  Description of Artificial Sequence: Synthetic oligonucleotide
  modified_base (1)..(1): a, c, u, g, unknown or other
ncaaaaucuuaggugacuc

SEQ ID NO: 1752 - RNA, 19 nt, Artificial Sequence
  Description of Artificial Sequence: Synthetic oligonucleotide
  modified_base (1)..(1): a, c, u, g, unknown or other
nauugauuuaaaaugccac

SEQ ID NO: 1753 - RNA, 19 nt, Artificial Sequence
  Description of Artificial Sequence: Synthetic oligonucleotide
  modified_base (1)..(1): a, c, u, g, unknown or other
nagaaaucgcugcuguccu

SEQ ID NO: 1754 - RNA, 19 nt, Artificial Sequence
  Description of Artificial Sequence: Synthetic oligonucleotide
  modified_base (1)..(1): a, c, u, g, unknown or other
nauaagaaaaucauccuga

SEQ ID NO: 1755 - RNA, 19 nt, Artificial Sequence
  Description of Artificial Sequence: Synthetic oligonucleotide
  modified_base (1)..(1): a, c, u, g, unknown or other
naaacaccguauuagggaa

SEQ ID NO: 1756 - RNA, 19 nt, Artificial Sequence
  Description of Artificial Sequence: Synthetic oligonucleotide
  modified_base (1)..(1): a, c, u, g, unknown or other
naaaucagugucaugguaa

SEQ ID NO: 1757 - RNA, 19 nt, Artificial Sequence
  Description of Artificial Sequence: Synthetic oligonucleotide
  modified_base (1)..(1): a, c, u, g, unknown or other
nauacccgcuuucugccau

SEQ ID NO: 1758 - RNA, 19 nt, Artificial Sequence
  Description of Artificial Sequence: Synthetic oligonucleotide
  modified_base (1)..(1): a, c, u, g, unknown or other
nagauguuuuaaggagaca

SEQ ID NO: 1759 - RNA, 19 nt, Artificial Sequence
  Description of Artificial Sequence: Synthetic oligonucleotide
  modified_base (1)..(1): a, c, u, g, unknown or other
ngguaucuuggcuuucugg

SEQ ID NO: 1760 - RNA, 19 nt, Artificial Sequence
  Description of Artificial Sequence: Synthetic oligonucleotide
  modified_base (1)..(1): a, c, u, g, unknown or other
ncucuguaucucuucuggc

SEQ ID NO: 1761 - RNA, 19 nt, Artificial Sequence
  Description of Artificial Sequence: Synthetic oligonucleotide
  modified_base (1)..(1): a, c, u, g, unknown or other
nauggauuauuauuucuug

SEQ ID NO: 1762 - RNA, 19 nt, Artificial Sequence
  Description of Artificial Sequence: Synthetic oligonucleotide
  modified_base (1)..(1): a, c, u, g, unknown or other
nagccagauuagaaagugc

SEQ ID NO: 1763 - RNA, 19 nt, Artificial Sequence
  Description of Artificial Sequence: Synthetic oligonucleotide
  modified_base (1)..(1): a, c, u, g, unknown or other
nagcggacggcauuggugc

SEQ ID NO: 1764 - RNA, 19 nt, Artificial Sequence
  Description of Artificial Sequence: Synthetic oligonucleotide
  modified_base (1)..(1): a, c, u, g, unknown or other
nauuucagauugauuuaaa

SEQ ID NO: 1765 - RNA, 20 nt, Artificial Sequence
  Description of Artificial Sequence: Synthetic oligonucleotide
  modified_base (1)..(1): a, c, u, g, unknown or other
nuugucucuuaguuucucug

SEQ ID NO: 1766 - RNA, 19 nt, Artificial Sequence
  Description of Artificial Sequence: Synthetic oligonucleotide
  modified_base (1)..(1): a, c, u, g, unknown or other
nagaacacugggaugcugu

SEQ ID NO: 1767 - RNA, 19 nt, Artificial Sequence
  Description of Artificial Sequence: Synthetic oligonucleotide
  modified_base (1)..(1): a, c, u, g, unknown or other
nccacuugauauaagaaaa

SEQ ID NO: 1768 - RNA, 19 nt, Artificial Sequence
  Description of Artificial Sequence: Synthetic oligonucleotide
  modified_base (1)..(1): a, c, u, g, unknown or other
ncauuuucuuacaaacacc

SEQ ID NO: 1769 - RNA, 19 nt, Artificial Sequence
  Description of Artificial Sequence: Synthetic oligonucleotide
  modified_base (1)..(1): a, c, u, g, unknown or other
nuaaugcguguacugggca

SEQ ID NO: 1770 - RNA, 19 nt, Artificial Sequence
  Description of Artificial Sequence: Synthetic oligonucleotide
  modified_base (1)..(1): a, c, u, g, unknown or other
naggacagagggccucccg

SEQ ID NO: 1771 - RNA, 19 nt, Artificial Sequence
  Description of Artificial Sequence: Synthetic oligonucleotide
  modified_base (1)..(1): a, c, u, g, unknown or other
ncaaccgggaugaugagug

SEQ ID NO: 1772 - RNA, 19 nt, Artificial Sequence
  Description of Artificial Sequence: Synthetic oligonucleotide
  modified_base (1)..(1): a, c, u, g, unknown or other
ngacaaagauuucuuugag

SEQ ID NO: 1773 - RNA, 19 nt, Artificial Sequence
  Description of Artificial Sequence: Synthetic oligonucleotide
  modified_base (1)..(1): a, c, u, g, unknown or other
ngaggaagcaugcuggcac

SEQ ID NO: 1774 - RNA, 19 nt, Artificial Sequence
  Description of Artificial Sequence: Synthetic oligonucleotide
  modified_base (1)..(1): a, c, u, g, unknown or other
nggaaaaugucccuaauac

SEQ ID NO: 1775 - RNA, 19 nt, Artificial Sequence
  Description of Artificial Sequence: Synthetic oligonucleotide
  modified_base (1)..(1): a, c, u, g, unknown or other
nuuaaguaacacuugcccu

SEQ ID NO: 1776 - RNA, 19 nt, Artificial Sequence
  Description of Artificial Sequence: Synthetic oligonucleotide
  modified_base (1)..(1): a, c, u, g, unknown or other
ncaauaucauacccgcuuu

SEQ ID NO: 1777 - RNA, 19 nt, Artificial Sequence
  Description of Artificial Sequence: Synthetic oligonucleotide
  modified_base (1)..(1): a, c, u, g, unknown or other
naaauguaccacuugauau

SEQ ID NO: 1778 - RNA, 19 nt, Artificial Sequence
  Description of Artificial Sequence: Synthetic oligonucleotide
  modified_base (1)..(1): a, c, u, g, unknown or other
nagaaaaucauccugaaaa

SEQ ID NO: 1779 - RNA, 19 nt, Artificial Sequence
  Description of Artificial Sequence: Synthetic oligonucleotide
  modified_base (1)..(1): a, c, u, g, unknown or other
nuaacacuugcccuucccu

SEQ ID NO: 1780 - RNA, 19 nt, Artificial Sequence
  Description of Artificial Sequence: Synthetic oligonucleotide
  modified_base (1)..(1): a, c, u, g, unknown or other
nagcauuuucuuacaaaca

SEQ ID NO: 1781 - RNA, 19 nt, Artificial Sequence
  Description of Artificial Sequence: Synthetic oligonucleotide
  modified_base (1)..(1): a, c, u, g, unknown or other
ncaaacaccguauuaggga

SEQ ID NO: 1782 - RNA, 19 nt, Artificial Sequence
  Description of Artificial Sequence: Synthetic oligonucleotide
  modified_base (1)..(1): a, c, u, g, unknown or other
nagcggcuguuaauaucca

SEQ ID NO: 1783 - RNA, 19 nt, Artificial Sequence
  Description of Artificial Sequence: Synthetic oligonucleotide
  modified_base (1)..(1): a, c, u, g, unknown or other
ngagcggcuguuaauaucc

SEQ ID NO: 1784 - RNA, 19 nt, Artificial Sequence
  Description of Artificial Sequence: Synthetic oligonucleotide
  modified_base (1)..(1): a, c, u, g, unknown or other
ngagacaaagauuucuuug

SEQ ID NO: 1785 - RNA, 19 nt, Artificial Sequence
  Description of Artificial Sequence: Synthetic oligonucleotide
  modified_base (1)..(1): a, c, u, g, unknown or other
nuggguuauuuuauguccu

SEQ ID NO: 1786 - RNA, 19 nt, Artificial Sequence
  Description of Artificial Sequence: Synthetic oligonucleotide
  modified_base (1)..(1): a, c, u, g, unknown or other
ngagccaugacacugucga

SEQ ID NO: 1787 - RNA, 19 nt, Artificial Sequence
  Description of Artificial Sequence: Synthetic oligonucleotide
  modified_base (1)..(1): a, c, u, g, unknown or other
ncagauuagaaagugcaca

SEQ ID NO: 1788 - RNA, 19 nt, Artificial Sequence
  Description of Artificial Sequence: Synthetic oligonucleotide
  modified_base (1)..(1): a, c, u, g, unknown or other
nagaauacccagaaaucgc

SEQ ID NO: 1789 - RNA, 19 nt, Artificial Sequence
  Description of Artificial Sequence: Synthetic oligonucleotide
  modified_base (1)..(1): a, c, u, g, unknown or other
ncagauguuuuaaggagac

SEQ ID NO: 1790 - RNA, 19 nt, Artificial Sequence
  Description of Artificial Sequence: Synthetic oligonucleotide
  modified_base (1)..(1): a, c, u, g, unknown or other
nuguauccagagaugccuc

SEQ ID NO: 1791 - RNA, 19 nt, Artificial Sequence
  Description of Artificial Sequence: Synthetic oligonucleotide
  modified_base (1)..(1): a, c, u, g, unknown or other
ngagucacacauucaccag

SEQ ID NO: 1792 - RNA, 19 nt, Artificial Sequence
  Description of Artificial Sequence: Synthetic oligonucleotide
  modified_base (1)..(1): a, c, u, g, unknown or other
ncaaagaaagauguguccu

SEQ ID NO: 1793 - RNA, 19 nt, Artificial Sequence
  Description of Artificial Sequence: Synthetic oligonucleotide
  modified_base (1)..(1): a, c, u, g, unknown or other
naccacuugauauaagaaa

SEQ ID NO: 1794 - RNA, 19 nt, Artificial Sequence
  Description of Artificial Sequence: Synthetic oligonucleotide
  modified_base (1)..(1): a, c, u, g, unknown or other
naagaaagcuuuaaguaac

SEQ ID NO: 1795 - RNA, 19 nt, Artificial Sequence
  Description of Artificial Sequence: Synthetic oligonucleotide
  modified_base (1)..(1): a, c, u, g, unknown or other
nuuauuucagauugauuua

SEQ ID NO: 1796 - RNA, 19 nt, Artificial Sequence
  Description of Artificial Sequence: Synthetic oligonucleotide
  modified_base (1)..(1): a, c, u, g, unknown or other
nuggugugagcauugcuug

SEQ ID NO: 1797 - RNA, 19 nt, Artificial Sequence
  Description of Artificial Sequence: Synthetic oligonucleotide
  modified_base (1)..(1): a, c, u, g, unknown or other
naucauccugaaaagaccu

SEQ ID NO: 1798 - RNA, 19 nt, Artificial Sequence
  Description of Artificial Sequence: Synthetic oligonucleotide
  modified_base (1)..(1): a, c, u, g, unknown or other
ngugagcauugcuugaaag

SEQ ID NO: 1799 - RNA, 19 nt, Artificial Sequence
  Description of Artificial Sequence: Synthetic oligonucleotide
  modified_base (1)..(1): a, c, u, g, unknown or other
ncuguaucucuucuggcac

SEQ ID NO: 1800 - RNA, 19 nt, Artificial Sequence
  Description of Artificial Sequence: Synthetic oligonucleotide
  modified_base (1)..(1): a, c, u, g, unknown or other
naccuuaauguguauccag

SEQ ID NO: 1801 - RNA, 19 nt, Artificial Sequence
  Description of Artificial Sequence: Synthetic oligonucleotide
  modified_base (1)..(1): a, c, u, g, unknown or other
naucauggauuauuauuuc

SEQ ID NO: 1802 - RNA, 19 nt, Artificial Sequence
  Description of Artificial Sequence: Synthetic oligonucleotide
  modified_base (1)..(1): a, c, u, g, unknown or other
ncaaagauuucuuugagau

SEQ ID NO: 1803 - RNA, 19 nt, Artificial Sequence
  Description of Artificial Sequence: Synthetic oligonucleotide
  modified_base (1)..(1): a, c, u, g, unknown or other
ngaaguauuuuaguuggag

SEQ ID NO: 1804 - RNA, 19 nt, Artificial Sequence
  Description of Artificial Sequence: Synthetic oligonucleotide
  modified_base (1)..(1): a, c, u, g, unknown or other
nagauugauuuaaaaugcc

SEQ ID NO: 1805 - RNA, 19 nt, Artificial Sequence
  Description of Artificial Sequence: Synthetic oligonucleotide
  modified_base (1)..(1): a, c, u, g, unknown or other
nggguaucuuggcuuucug

SEQ ID NO: 1806 - RNA, 19 nt, Artificial Sequence
  Description of Artificial Sequence: Synthetic oligonucleotide
  modified_base (1)..(1): a, c, u, g, unknown or other
naggagacaaagauuucuu

SEQ ID NO: 1807 - RNA, 19 nt, Artificial Sequence
  Description of Artificial Sequence: Synthetic oligonucleotide
  modified_base (1)..(1): a, c, u, g, unknown or other
ngucaugguaaaaugaaga

SEQ ID NO: 1808 - RNA, 19 nt, Artificial Sequence
  Description of Artificial Sequence: Synthetic oligonucleotide
  modified_base (1)..(1): a, c, u, g, unknown or other
nauauccaguucuucuccc

SEQ ID NO: 1809 - RNA, 19 nt, Artificial Sequence
  Description of Artificial Sequence: Synthetic oligonucleotide
  modified_base (1)..(1): a, c, u, g, unknown or other
naauauccaguucuucucc

SEQ ID NO: 1810 - RNA, 19 nt, Artificial Sequence
  Description of Artificial Sequence: Synthetic oligonucleotide
  modified_base (1)..(1): a, c, u, g, unknown or other
ncugugguuuccaguuuca

SEQ ID NO: 1811 - RNA, 19 nt, Artificial Sequence
  Description of Artificial Sequence: Synthetic oligonucleotide
  modified_base (1)..(1): a, c, u, g, unknown or other
nagauuagaaagugcacag

SEQ ID NO: 1812 - RNA, 19 nt, Artificial Sequence
  Description of Artificial Sequence: Synthetic oligonucleotide
  modified_base (1)..(1): a, c, u, g, unknown or other
nagaaaucagugucauggu

SEQ ID NO: 1813 - RNA, 19 nt, Artificial Sequence
  Description of Artificial Sequence: Synthetic oligonucleotide
  modified_base (1)..(1): a, c, u, g, unknown or other
nuggauuauuauuucuuga

SEQ ID NO: 1814 - RNA, 19 nt, Artificial Sequence
  Description of Artificial Sequence: Synthetic oligonucleotide
  modified_base (1)..(1): a, c, u, g, unknown or other
nccagauuagaaagugcac

SEQ ID NO: 1815 - RNA, 19 nt, Artificial Sequence
  Description of Artificial Sequence: Synthetic oligonucleotide
  modified_base (1)..(1): a, c, u, g, unknown or other
ncucauuauccauuuuaca

SEQ ID NO: 1816 - RNA, 19 nt, Artificial Sequence
  Description of Artificial Sequence: Synthetic oligonucleotide
  modified_base (1)..(1): a, c, u, g, unknown or other
nuugggccauuccugggaa

SEQ ID NO: 1817 - RNA, 19 nt, Artificial Sequence
  Description of Artificial Sequence: Synthetic oligonucleotide
  modified_base (1)..(1): a, c, u, g, unknown or other
nugggcuugauuuuggugg

SEQ ID NO: 1818 - RNA, 19 nt, Artificial Sequence
  Description of Artificial Sequence: Synthetic oligonucleotide
  modified_base (1)..(1): a, c, u, g, unknown or other
ncagauugauuuaaaaugc

SEQ ID NO: 1819 - RNA, 19 nt, Artificial Sequence
  Description of Artificial Sequence: Synthetic oligonucleotide
  modified_base (1)..(1): a, c, u, g, unknown or other
naagcaaccgggaugauga

SEQ ID NO: 1820 - RNA, 19 nt, Artificial Sequence
  Description of Artificial Sequence: Synthetic oligonucleotide
  modified_base (1)..(1): a, c, u, g, unknown or other
ncuuaauguguauccagag

SEQ ID NO: 1821 - RNA, 19 nt, Artificial Sequence
  Description of Artificial Sequence: Synthetic oligonucleotide
  modified_base (1)..(1): a, c, u, g, unknown or other
nguaauucacugugguuuc

SEQ ID NO: 1822 - RNA, 19 nt, Artificial Sequence
  Description of Artificial Sequence: Synthetic oligonucleotide
  modified_base (1)..(1): a, c, u, g, unknown or other
nacauuucuaucuccuuug

SEQ ID NO: 1823 - RNA, 19 nt, Artificial Sequence
  Description of Artificial Sequence: Synthetic oligonucleotide
  modified_base (1)..(1): a, c, u, g, unknown or other
ncacugguuuccaaugaug

SEQ ID NO: 1824 - RNA, 19 nt, Artificial Sequence
  Description of Artificial Sequence: Synthetic oligonucleotide
  modified_base (1)..(1): a, c, u, g, unknown or other
ngaaucuguguaauucacu

SEQ ID NO: 1825 - RNA, 19 nt, Artificial Sequence
  Description of Artificial Sequence: Synthetic oligonucleotide
  modified_base (1)..(1): a, c, u, g, unknown or other
nguccuauucacucuuggc

SEQ ID NO: 1826 - RNA, 19 nt, Artificial Sequence
  Description of Artificial Sequence: Synthetic oligonucleotide
  modified_base (1)..(1): a, c, u, g, unknown or other
nagcauugcuugaaagaau

SEQ ID NO: 1827 - RNA, 19 nt, Artificial Sequence
  Description of Artificial Sequence: Synthetic oligonucleotide
  modified_base (1)..(1): a, c, u, g, unknown or other
naauacccagaaaucgcug

SEQ ID NO: 1828 - RNA, 19 nt, Artificial Sequence
  Description of Artificial Sequence: Synthetic oligonucleotide
  modified_base (1)..(1): a, c, u, g, unknown or other
nauuauuauuucuugaacc

SEQ ID NO: 1829 - RNA, 19 nt, Artificial Sequence
  Description of Artificial Sequence: Synthetic oligonucleotide
  modified_base (1)..(1): a, c, u, g, unknown or other
naaguauuuuaguuggaga

SEQ ID NO: 1830 - RNA, 19 nt, Artificial Sequence
  Description of Artificial Sequence: Synthetic oligonucleotide
  modified_base (1)..(1): a, c, u, g, unknown or other
ngaauccaguccacguacu

SEQ ID NO: 1831 - RNA, 19 nt, Artificial Sequence
  Description of Artificial Sequence: Synthetic oligonucleotide
  modified_base (1)..(1): a, c, u, g, unknown or other
nagacaaagauuucuuuga

SEQ ID NO: 1832 - RNA, 19 nt, Artificial Sequence
  Description of Artificial Sequence: Synthetic oligonucleotide
  modified_base (1)..(1): a, c, u, g, unknown or other
nacaggauuucagugaaaa

SEQ ID NO: 1833 - RNA, 19 nt, Artificial Sequence
  Description of Artificial Sequence: Synthetic oligonucleotide
  modified_base (1)..(1): a, c, u, g, unknown or other
naacaaggcaauaucauac

SEQ ID NO: 1834 - RNA, 19 nt, Artificial Sequence
  Description of Artificial Sequence: Synthetic oligonucleotide
  modified_base (1)..(1): a, c, u, g, unknown or other
naaggcaauaucauacccg

SEQ ID NO: 1835 - RNA, 19 nt, Artificial Sequence
  Description of Artificial Sequence: Synthetic oligonucleotide
  modified_base (1)..(1): a, c, u, g, unknown or other
nauacccagaaaucgcugc

SEQ ID NO: 1836 - RNA, 19 nt, Artificial Sequence
  Description of Artificial Sequence: Synthetic oligonucleotide
  modified_base (1)..(1): a, c, u, g, unknown or other
ngauugauuuaaaaugcca

SEQ ID NO: 1837 - RNA, 19 nt, Artificial Sequence
  Description of Artificial Sequence: Synthetic oligonucleotide
  modified_base (1)..(1): a, c, u, g, unknown or other
nccuauucacucuuggcag

SEQ ID NO: 1838 - RNA, 19 nt, Artificial Sequence
  Description of Artificial Sequence: Synthetic oligonucleotide
  modified_base (1)..(1): a, c, u, g, unknown or other
nguagacacgcaaaaucuu

SEQ ID NO: 1839 - RNA, 19 nt, Artificial Sequence
  Description of Artificial Sequence: Synthetic oligonucleotide
  modified_base (1)..(1): a, c, u, g, unknown or other
nugaguuuucuccagaauc

SEQ ID NO: 1840 - RNA, 19 nt, Artificial Sequence
  Description of Artificial Sequence: Synthetic oligonucleotide
  modified_base (1)..(1): a, c, u, g, unknown or other
nauuucuuugagauucuuu

SEQ ID NO: 1841 - RNA, 19 nt, Artificial Sequence
  Description of Artificial Sequence: Synthetic oligonucleotide
  modified_base (1)..(1): a, c, u, g, unknown or other
nuauaagaaaaucauccug

SEQ ID NO: 1842 - RNA, 19 nt, Artificial Sequence
  Description of Artificial Sequence: Synthetic oligonucleotide
  modified_base (1)..(1): a, c, u, g, unknown or other
naaaaucuuaggugacucu

SEQ ID NO: 1843 - RNA, 19 nt, Artificial Sequence
  Description of Artificial Sequence: Synthetic oligonucleotide
  modified_base (1)..(1): a, c, u, g, unknown or other
nacacugggaugcugugcc

SEQ ID NO: 1844 - RNA, 19 nt, Artificial Sequence
  Description of Artificial Sequence: Synthetic oligonucleotide
  modified_base (1)..(1): a, c, u, g, unknown or other
nugcacaggauuucaguga

SEQ ID NO: 1845 - RNA, 19 nt, Artificial Sequence
  Description of Artificial Sequence: Synthetic oligonucleotide
  modified_base (1)..(1): a, c, u, g, unknown or other
nauacaagccagauuagaa

SEQ ID NO: 1846 - RNA, 19 nt, Artificial Sequence
  Description of Artificial Sequence: Synthetic oligonucleotide
  modified_base (1)..(1): a, c, u, g, unknown or other
nugugguuuccaguuucaa

SEQ ID NO: 1847 - RNA, 19 nt, Artificial Sequence
  Description of Artificial Sequence: Synthetic oligonucleotide
  modified_base (1)..(1): a, c, u, g, unknown or other
nugcccuucccuucguugc

SEQ ID NO: 1848 - RNA, 19 nt, Artificial Sequence
  Description of Artificial Sequence: Synthetic oligonucleotide
  modified_base (1)..(1): a, c, u, g, unknown or other
naaaaucauccugaaaaga

SEQ ID NO: 1849 - RNA, 19 nt, Artificial Sequence
  Description of Artificial Sequence: Synthetic oligonucleotide
  modified_base (1)..(1): a, c, u, g, unknown or other
nccaagaaaucagugucau

SEQ ID NO: 1850 - RNA, 19 nt, Artificial Sequence
  Description of Artificial Sequence: Synthetic oligonucleotide
  modified_base (1)..(1): a, c, u, g, unknown or other
nggcauaugggucguugag

SEQ ID NO: 1851 - RNA, 19 nt, Artificial Sequence
  Description of Artificial Sequence: Synthetic oligonucleotide
  modified_base (1)..(1): a, c, u, g, unknown or other
nagaaucuguguaauucac

SEQ ID NO: 1852 - RNA, 19 nt, Artificial Sequence
  Description of Artificial Sequence: Synthetic oligonucleotide
  modified_base (1)..(1): a, c, u, g, unknown or other
nauccaguccacguacucg

SEQ ID NO: 1853 - RNA, 19 nt, Artificial Sequence
  Description of Artificial Sequence: Synthetic oligonucleotide
  modified_base (1)..(1): a, c, u, g, unknown or other
nccucuguaucucuucugg

SEQ ID NO: 1854 - RNA, 19 nt, Artificial Sequence
  Description of Artificial Sequence: Synthetic oligonucleotide
  modified_base (1)..(1): a, c, u, g, unknown or other
ngcacaggauuucagugaa

SEQ ID NO: 1855 - RNA, 19 nt, Artificial Sequence
  Description of Artificial Sequence: Synthetic oligonucleotide
  modified_base (1)..(1): a, c, u, g, unknown or other
nguaaaaugaagaauggca

SEQ ID NO: 1856 - RNA, 19 nt, Artificial Sequence
  Description of Artificial Sequence: Synthetic oligonucleotide
  modified_base (1)..(1): a, c, u, g, unknown or other
ngucguugagaaucugugu

SEQ ID NO: 1857 - RNA, 19 nt, Artificial Sequence
  Description of Artificial Sequence: Synthetic oligonucleotide
  modified_base (1)..(1): a, c, u, g, unknown or other
ngcaacaauauccaguucu

SEQ ID NO: 1858 - RNA, 19 nt, Artificial Sequence
  Description of Artificial Sequence: Synthetic oligonucleotide
  modified_base (1)..(1): a, c, u, g, unknown or other
ncagcggacggcauuggug

SEQ ID NO: 1859 - RNA, 19 nt, Artificial Sequence
  Description of Artificial Sequence: Synthetic oligonucleotide
  modified_base (1)..(1): a, c, u, g, unknown or other
ngaaagcuuuaaguaacac

SEQ ID NO: 1860 - RNA, 19 nt, Artificial Sequence
  Description of Artificial Sequence: Synthetic oligonucleotide
  modified_base (1)..(1): a, c, u, g, unknown or other
ngcaguguuucuguaacac

SEQ ID NO: 1861 - RNA, 19 nt, Artificial Sequence
  Description of Artificial Sequence: Synthetic oligonucleotide
  modified_base (1)..(1): a, c, u, g, unknown or other
ngagaaucuguguaauuca

SEQ ID NO: 1862 - RNA, 19 nt, Artificial Sequence
  Description of Artificial Sequence: Synthetic oligonucleotide
  modified_base (1)..(1): a, c, u, g, unknown or other
nuccaguccacguacucga

SEQ ID NO: 1863 - RNA, 19 nt, Artificial Sequence
  Description of Artificial Sequence: Synthetic oligonucleotide
  modified_base (1)..(1): a, c, u, g, unknown or other
nugugagcauugcuugaaa

SEQ ID NO: 1864 - RNA, 19 nt, Artificial Sequence
  Description of Artificial Sequence: Synthetic oligonucleotide
  modified_base (1)..(1): a, c, u, g, unknown or other
nccgggaugaugagugcag

SEQ ID NO: 1865 - RNA, 19 nt, Artificial Sequence
  Description of Artificial Sequence: Synthetic oligonucleotide
  modified_base (1)..(1): a, c, u, g, unknown or other
nccacuuuaucgagcuucg

SEQ ID NO: 1866 - RNA, 19 nt, Artificial Sequence
  Description of Artificial Sequence: Synthetic oligonucleotide
  modified_base (1)..(1): a, c, u, g, unknown or other
ncauuauccauuuuacaca

SEQ ID NO: 1867 - RNA, 19 nt, Artificial Sequence
  Description of Artificial Sequence: Synthetic oligonucleotide
  modified_base (1)..(1): a, c, u, g, unknown or other
naaccgggaugaugagugc

SEQ ID NO: 1868 - RNA, 19 nt, Artificial Sequence
  Description of Artificial Sequence: Synthetic oligonucleotide
  modified_base (1)..(1): a, c, u, g, unknown or other
nuucuuugggccauuccug

SEQ ID NO: 1869 - RNA, 19 nt, Artificial Sequence
  Description of Artificial Sequence: Synthetic oligonucleotide
  modified_base (1)..(1): a, c, u, g, unknown or other
ncuaaggguaucuuggcuu

SEQ ID NO: 1870 - RNA, 19 nt, Artificial Sequence
  Description of Artificial Sequence: Synthetic oligonucleotide
  modified_base (1)..(1): a, c, u, g, unknown or other
nuuggugugagcauugcuu

SEQ ID NO: 1871 - RNA, 19 nt, Artificial Sequence
  Description of Artificial Sequence: Synthetic oligonucleotide
  modified_base (1)..(1): a, c, u, g, unknown or other
ncauaugggucguugagaa

SEQ ID NO: 1872 - RNA, 19 nt, Artificial Sequence
  Description of Artificial Sequence: Synthetic oligonucleotide
  modified_base (1)..(1): a, c, u, g, unknown or other
nuuaauguguauccagaga

SEQ ID NO: 1873 - RNA, 19 nt, Artificial Sequence
  Description of Artificial Sequence: Synthetic oligonucleotide
  modified_base (1)..(1): a, c, u, g, unknown or other
nucagauguuuuaaggaga

SEQ ID NO: 1874 - RNA, 19 nt, Artificial Sequence
  Description of Artificial Sequence: Synthetic oligonucleotide
  modified_base (1)..(1): a, c, u, g, unknown or other
nuuccaaugauggagccuc

SEQ ID NO: 1875 - RNA, 19 nt, Artificial Sequence
  Description of Artificial Sequence: Synthetic oligonucleotide
  modified_base (1)..(1): a, c, u, g, unknown or other
nagaauccaguccacguac

SEQ ID NO: 1876 - RNA, 19 nt, Artificial Sequence
  Description of Artificial Sequence: Synthetic oligonucleotide
  modified_base (1)..(1): a, c, u, g, unknown or other
nuuugagauucuuugggcc

SEQ ID NO: 1877 - RNA, 19 nt, Artificial Sequence
  Description of Artificial Sequence: Synthetic oligonucleotide
  modified_base (1)..(1): a, c, u, g, unknown or other
naaucauccugaaaagacc

SEQ ID NO: 1878 - RNA, 19 nt, Artificial Sequence
  Description of Artificial Sequence: Synthetic oligonucleotide
  modified_base (1)..(1): a, c, u, g, unknown or other
nagacacgcaaaaucuuag

SEQ ID NO: 1879 - RNA, 19 nt, Artificial Sequence
  Description of Artificial Sequence: Synthetic oligonucleotide
  modified_base (1)..(1): a, c, u, g, unknown or other
ncguacucgaccacguugg

SEQ ID NO: 1880 - RNA, 19 nt, Artificial Sequence
  Description of Artificial Sequence: Synthetic oligonucleotide
  modified_base (1)..(1): a, c, u, g, unknown or other
ncauccagucacccagcaa

SEQ ID NO: 1881 - RNA, 19 nt, Artificial Sequence
  Description of Artificial Sequence: Synthetic oligonucleotide
  modified_base (1)..(1): a, c, u, g, unknown or other
naacacugggaugcugugc

SEQ ID NO: 1882 - RNA, 19 nt, Artificial Sequence
  Description of Artificial Sequence: Synthetic oligonucleotide
  modified_base (1)..(1): a, c, u, g, unknown or other
ncagaaagagcuuugcucu

SEQ ID NO: 1883 - RNA, 19 nt, Artificial Sequence
  Description of Artificial Sequence: Synthetic oligonucleotide
  modified_base (1)..(1): a, c, u, g, unknown or other
nuucuuugagauucuuugg

SEQ ID NO: 1884 - RNA, 19 nt, Artificial Sequence
  Description of Artificial Sequence: Synthetic oligonucleotide
  modified_base (1)..(1): a, c, u, g, unknown or other
nagcaacaauauccaguuc

SEQ ID NO: 1885 - RNA, 19 nt, Artificial Sequence
  Description of Artificial Sequence: Synthetic oligonucleotide
  modified_base (1)..(1): a, c, u, g, unknown or other
naccacuuuaucgagcuuc

SEQ ID NO: 1886 - RNA, 19 nt, Artificial Sequence
  Description of Artificial Sequence: Synthetic oligonucleotide
  modified_base (1)..(1): a, c, u, g, unknown or other
ncccuucccuucguugcag

SEQ ID NO: 1887 - RNA, 19 nt, Artificial Sequence
  Description of Artificial Sequence: Synthetic oligonucleotide
  modified_base (1)..(1): a, c, u, g, unknown or other
ncgcaaaaucuuaggugac

SEQ ID NO: 1888 - RNA, 19 nt, Artificial Sequence
  Description of Artificial Sequence: Synthetic oligonucleotide
  modified_base (1)..(1): a, c, u, g, unknown or other
nagcguguuacuguggagg

SEQ ID NO: 1889 - RNA, 19 nt, Artificial Sequence
  Description of Artificial Sequence: Synthetic oligonucleotide
  modified_base (1)..(1): a, c, u, g, unknown or other
ncuccuucccuguagccgg

SEQ ID NO: 1890 - RNA, 19 nt, Artificial Sequence
  Description of Artificial Sequence: Synthetic oligonucleotide
  modified_base (1)..(1): a, c, u, g, unknown or other
nguccucuguaucucuucu

SEQ ID NO: 1891 - RNA, 19 nt, Artificial Sequence
  Description of Artificial Sequence: Synthetic oligonucleotide
  modified_base (1)..(1): a, c, u, g, unknown or other
nguaucuuggcuuucugga

SEQ ID NO: 1892 - RNA, 19 nt, Artificial Sequence
  Description of Artificial Sequence: Synthetic oligonucleotide
  modified_base (1)..(1): a, c, u, g, unknown or other
ncucuuggcaguguuucug

SEQ ID NO: 1893 - RNA, 19 nt, Artificial Sequence
  Description of Artificial Sequence: Synthetic oligonucleotide
  modified_base (1)..(1): a, c, u, g, unknown or other
ngaaaucagugucauggua

SEQ ID NO: 1894 - RNA, 19 nt, Artificial Sequence
  Description of Artificial Sequence: Synthetic oligonucleotide
  modified_base (1)..(1): a, c, u, g, unknown or other
ncuucccuguagccggcac

SEQ ID NO: 1895 - RNA, 19 nt, Artificial Sequence
  Description of Artificial Sequence: Synthetic oligonucleotide
  modified_base (1)..(1): a, c, u, g, unknown or other
ncuggccgcucccuuugag

SEQ ID NO: 1896 - RNA, 19 nt, Artificial Sequence
  Description of Artificial Sequence: Synthetic oligonucleotide
  modified_base (1)..(1): a, c, u, g, unknown or other
ncacgcaaaaucuuaggug

SEQ ID NO: 1897 - RNA, 19 nt, Artificial Sequence
  Description of Artificial Sequence: Synthetic oligonucleotide
  modified_base (1)..(1): a, c, u, g, unknown or other
ngaaaccagaaagagcuuu

SEQ ID NO: 1898 - RNA, 19 nt, Artificial Sequence
  Description of Artificial Sequence: Synthetic oligonucleotide
  modified_base (1)..(1): a, c, u, g, unknown or other
naaagcuuuaaguaacacu

SEQ ID NO: 1899 - RNA, 19 nt, Artificial Sequence
  Description of Artificial Sequence: Synthetic oligonucleotide
  modified_base (1)..(1): a, c, u, g, unknown or other
nacaagccagauuagaaag

SEQ ID NO: 1900 - RNA, 19 nt, Artificial Sequence
  Description of Artificial Sequence: Synthetic oligonucleotide
  modified_base (1)..(1): a, c, u, g, unknown or other
nacucauuauccauuuuac

SEQ ID NO: 1901 - RNA, 19 nt, Artificial Sequence
  Description of Artificial Sequence: Synthetic oligonucleotide
  modified_base (1)..(1): a, c, u, g, unknown or other
nccugaaaagaccuuguug

SEQ ID NO: 1902 - RNA, 19 nt, Artificial Sequence
  Description of Artificial Sequence: Synthetic oligonucleotide
  modified_base (1)..(1): a, c, u, g, unknown or other
ngguuuccaaugauggagc

SEQ ID NO: 1903 - RNA, 19 nt, Artificial Sequence
  Description of Artificial Sequence: Synthetic oligonucleotide
  modified_base (1)..(1): a, c, u, g, unknown or other
ncaguuucuggcaggccuc

SEQ ID NO: 1904 - RNA, 19 nt, Artificial Sequence
  Description of Artificial Sequence: Synthetic oligonucleotide
  modified_base (1)..(1): a, c, u, g, unknown or other
nauggcagaacacugggau

SEQ ID NO: 1905 - RNA, 19 nt, Artificial Sequence
  Description of Artificial Sequence: Synthetic oligonucleotide
  modified_base (1)..(1): a, c, u, g, unknown or other
nagauuucuuugagauucu

SEQ ID NO: 1906 - RNA, 19 nt, Artificial Sequence
  Description of Artificial Sequence: Synthetic oligonucleotide
  modified_base (1)..(1): a, c, u, g, unknown or other
nguuuccaguuucaacaag

SEQ ID NO: 1907 - RNA, 19 nt, Artificial Sequence
  Description of Artificial Sequence: Synthetic oligonucleotide
  modified_base (1)..(1): a, c, u, g, unknown or other
nuccucuguaucucuucug

SEQ ID NO: 1908 - RNA, 19 nt, Artificial Sequence
  Description of Artificial Sequence: Synthetic oligonucleotide
  modified_base (1)..(1): a, c, u, g, unknown or other
ncauccugaaaagaccuug

SEQ ID NO: 1909 - RNA, 19 nt, Artificial Sequence
  Description of Artificial Sequence: Synthetic oligonucleotide
  modified_base (1)..(1): a, c, u, g, unknown or other
nuugaguuuucuccagaau

SEQ ID NO: 1910 - RNA, 19 nt, Artificial Sequence
  Description of Artificial Sequence: Synthetic oligonucleotide
  modified_base (1)..(1): a, c, u, g, unknown or other
naauucacugugguuucca

SEQ ID NO: 1911 - RNA, 19 nt, Artificial Sequence
  Description of Artificial Sequence: Synthetic oligonucleotide
  modified_base (1)..(1): a, c, u, g, unknown or other
naagauuucuuugagauuc

SEQ ID NO: 1912 - RNA, 19 nt, Artificial Sequence
  Description of Artificial Sequence: Synthetic oligonucleotide
  modified_base (1)..(1): a, c, u, g, unknown or other
nggagacaaagauuucuuu

SEQ ID NO: 1913 - RNA, 19 nt, Artificial Sequence
  Description of Artificial Sequence: Synthetic oligonucleotide
  modified_base (1)..(1): a, c, u, g, unknown or other
ngaaaaucauccugaaaag

SEQ ID NO: 1914 - RNA, 19 nt, Artificial Sequence
  Description of Artificial Sequence: Synthetic oligonucleotide
  modified_base (1)..(1): a, c, u, g, unknown or other
ncuuucugccauuuuauac

SEQ ID NO: 1915 - RNA, 19 nt, Artificial Sequence
  Description of Artificial Sequence: Synthetic oligonucleotide
  modified_base (1)..(1): a, c, u, g, unknown or other
naguccacguacucgacca

SEQ ID NO: 1916 - RNA, 19 nt, Artificial Sequence
  Description of Artificial Sequence: Synthetic oligonucleotide
  modified_base (1)..(1): a, c, u, g, unknown or other
nuuaaugcguguacugggc

SEQ ID NO: 1917 - RNA, 19 nt, Artificial Sequence
  Description of Artificial Sequence: Synthetic oligonucleotide
  modified_base (1)..(1): a, c, u, g, unknown or other
nuaauguguauccagagau

SEQ ID NO: 1918 - RNA, 19 nt, Artificial Sequence
  Description of Artificial Sequence: Synthetic oligonucleotide
  modified_base (1)..(1): a, c, u, g, unknown or other
ngauucuuugggccauucc

SEQ ID NO: 1919 - RNA, 19 nt, Artificial Sequence
  Description of Artificial Sequence: Synthetic oligonucleotide
  modified_base (1)..(1): a, c, u, g, unknown or other
nugaaaccagaaagagcuu

SEQ ID NO: 1920 - RNA, 19 nt, Artificial Sequence
  Description of Artificial Sequence: Synthetic oligonucleotide
  modified_base (1)..(1): a, c, u, g, unknown or other
ncacacauucaccagaaac

SEQ ID NO: 1921 - RNA, 19 nt, Artificial Sequence
  Description of Artificial Sequence: Synthetic oligonucleotide
  modified_base (1)..(1): a, c, u, g, unknown or other
nacaaagauuucuuugaga

SEQ ID NO: 1922 - RNA, 19 nt, Artificial Sequence
  Description of Artificial Sequence: Synthetic oligonucleotide
  modified_base (1)..(1): a, c, u, g, unknown or other
ncauuucuaucuccuuugg

SEQ ID NO: 1923 - RNA, 19 nt, Artificial Sequence
  Description of Artificial Sequence: Synthetic oligonucleotide
  modified_base (1)..(1): a, c, u, g, unknown or other
nuuucuguaacacugucuu

SEQ ID NO: 1924 - RNA, 19 nt, Artificial Sequence
  Description of Artificial Sequence: Synthetic oligonucleotide
  modified_base (1)..(1): a, c, u, g, unknown or other
nggauuucagugaaaaucc

SEQ ID NO: 1925 - RNA, 20 nt, Artificial Sequence
  Description of Artificial Sequence: Synthetic oligonucleotide
  modified_base (1)..(1): a, c, u, g, unknown or other
ncgcucccuuugagcacamg

SEQ ID NO: 1926 - RNA, 20 nt, Artificial Sequence
  Description of Artificial Sequence: Synthetic oligonucleotide
  modified_base (1)..(1): a, c, u, g, unknown or other
  modified_base (15)..(15): a, c, u, g, unknown or other
ncaguccacguacuncgacc

SEQ ID NO: 1927 - RNA, 19 nt, Artificial Sequence
  Description of Artificial Sequence: Synthetic oligonucleotide
  modified_base (1)..(1): a, c, u, g, unknown or other
naggcauaugggucguuga

SEQ ID NO: 1928 - RNA, 19 nt, Artificial Sequence
  Description of Artificial Sequence: Synthetic oligonucleotide
  modified_base (1)..(1): a, c, u, g, unknown or other
nauguccucuguaucucuu

SEQ ID NO: 1929 - RNA, 19 nt, Artificial Sequence
  Description of Artificial Sequence: Synthetic oligonucleotide
  modified_base (1)..(1): a, c, u, g, unknown or other
ngcuugauuuuggugguac

SEQ ID NO: 1930 - RNA, 19 nt, Artificial Sequence
  Description of Artificial Sequence: Synthetic oligonucleotide
  modified_base (1)..(1): a, c, u, g, unknown or other
naugauggagccuccacac

SEQ ID NO: 1931 - RNA, 19 nt, Artificial Sequence
  Description of Artificial Sequence: Synthetic oligonucleotide
  modified_base (1)..(1): a, c, u, g, unknown or other
nucguugagaaucugugua

SEQ ID NO: 1932 - RNA, 19 nt, Artificial Sequence
  Description of Artificial Sequence: Synthetic oligonucleotide
  modified_base (1)..(1): a, c, u, g, unknown or other
nuuauccauuuuacacaac

SEQ ID NO: 1933 - RNA, 19 nt, Artificial Sequence
  Description of Artificial Sequence: Synthetic oligonucleotide
  modified_base (1)..(1): a, c, u, g, unknown or other
nuguccuauucacucuugg

SEQ ID NO: 1934 - RNA, 19 nt, Artificial Sequence
  Description of Artificial Sequence: Synthetic oligonucleotide
  modified_base (1)..(1): a, c, u, g, unknown or other
ncaauauccaguucuucuc

SEQ ID NO: 1935 - RNA, 19 nt, Artificial Sequence
  Description of Artificial Sequence: Synthetic oligonucleotide
  modified_base (1)..(1): a, c, u, g, unknown or other
ncuuugagauucuuugggc

SEQ ID NO: 1936 - RNA, 19 nt, Artificial Sequence
  Description of Artificial Sequence: Synthetic oligonucleotide
  modified_base (1)..(1): a, c, u, g, unknown or other
ncacucuuggcaguguuuc

SEQ ID NO: 1937 - RNA, 19 nt, Artificial Sequence
  Description of Artificial Sequence: Synthetic oligonucleotide
  modified_base (1)..(1): a, c, u, g, unknown or other
ncuugaaagaauacccaga

SEQ ID NO: 1938 - RNA, 19 nt, Artificial Sequence
  Description of Artificial Sequence: Synthetic oligonucleotide
  modified_base (1)..(1): a, c, u, g, unknown or other
naggcaauaucauacccgc

SEQ ID NO: 1939 - RNA, 19 nt, Artificial Sequence
  Description of Artificial Sequence: Synthetic oligonucleotide
  modified_base (1)..(1): a, c, u, g, unknown or other
ncuguguaauucacugugg

SEQ ID NO: 1940 - RNA, 19 nt, Artificial Sequence
  Description of Artificial Sequence: Synthetic oligonucleotide
  modified_base (1)..(1): a, c, u, g, unknown or other
naauauccacugguuucca

SEQ ID NO: 1941 - RNA, 19 nt, Artificial Sequence
  Description of Artificial Sequence: Synthetic oligonucleotide
  modified_base (1)..(1): a, c, u, g, unknown or other
nugaaagaauacccagaaa

SEQ ID NO: 1942 - RNA, 19 nt, Artificial Sequence
  Description of Artificial Sequence: Synthetic oligonucleotide
  modified_base (1)..(1): a, c, u, g, unknown or other
nguuaauauccacugguuu

SEQ ID NO: 1943 - RNA, 19 nt, Artificial Sequence
  Description of Artificial Sequence: Synthetic oligonucleotide
  modified_base (1)..(1): a, c, u, g, unknown or other
nugucaugguaaaaugaag

SEQ ID NO: 1944 - RNA, 19 nt, Artificial Sequence
  Description of Artificial Sequence: Synthetic oligonucleotide
  modified_base (1)..(1): a, c, u, g, unknown or other
nauucuuugggccauuccu

SEQ ID NO: 1945 - RNA, 19 nt, Artificial Sequence
  Description of Artificial Sequence: Synthetic oligonucleotide
  modified_base (1)..(1): a, c, u, g, unknown or other
ncaguuccuccaacgaucc

SEQ ID NO: 1946 - RNA, 19 nt, Artificial Sequence
  Description of Artificial Sequence: Synthetic oligonucleotide
  modified_base (1)..(1): a, c, u, g, unknown or other
ngggugugcuucaguagac

SEQ ID NO: 1947 - RNA, 19 nt, Artificial Sequence
  Description of Artificial Sequence: Synthetic oligonucleotide
  modified_base (1)..(1): a, c, u, g, unknown or other
ngaagaaagcuuuaaguaa

SEQ ID NO: 1948 - RNA, 19 nt, Artificial Sequence
  Description of Artificial Sequence: Synthetic oligonucleotide
  modified_base (1)..(1): a, c, u, g, unknown or other
nauccugaaaagaccuugu

SEQ ID NO: 1949 - RNA, 19 nt, Artificial Sequence
  Description of Artificial Sequence: Synthetic oligonucleotide
  modified_base (1)..(1): a, c, u, g, unknown or other
nagaaagcuuuaaguaaca

SEQ ID NO: 1950 - RNA, 19 nt, Artificial Sequence
  Description of Artificial Sequence: Synthetic oligonucleotide
  modified_base (1)..(1): a, c, u, g, unknown or other
ncaguguuucuguaacacu

SEQ ID NO: 1951 - RNA, 19 nt, Artificial Sequence
  Description of Artificial Sequence: Synthetic oligonucleotide
  modified_base (1)..(1): a, c, u, g, unknown or other
ngacacgcaaaaucuuagg

SEQ ID NO: 1952 - RNA, 19 nt, Artificial Sequence
  Description of Artificial Sequence: Synthetic oligonucleotide
  modified_base (1)..(1): a, c, u, g, unknown or other
ngugugagcauugcuugaa

SEQ ID NO: 1953 - RNA, 19 nt, Artificial Sequence
  Description of Artificial Sequence: Synthetic oligonucleotide
  modified_base (1)..(1): a, c, u, g, unknown or other
naccagaaagagcuuugcu

SEQ ID NO: 1954 - RNA, 19 nt, Artificial Sequence
  Description of Artificial Sequence: Synthetic oligonucleotide
  modified_base (1)..(1): a, c, u, g, unknown or other
nagaaagugcacaggauuu

SEQ ID NO: 1955 - RNA, 19 nt, Artificial Sequence
  Description of Artificial Sequence: Synthetic oligonucleotide
  modified_base (1)..(1): a, c, u, g, unknown or other
nuuuauuucagauugauuu

SEQ ID NO: 1956 - RNA, 19 nt, Artificial Sequence
  Description of Artificial Sequence: Synthetic oligonucleotide
  modified_base (1)..(1): a, c, u, g, unknown or other
nuauccaguucuucuccca

SEQ ID NO: 1957 - RNA, 19 nt, Artificial Sequence
  Description of Artificial Sequence: Synthetic oligonucleotide
  modified_base (1)..(1): a, c, u, g, unknown or other
nccgugaaagugaagagua

SEQ ID NO: 1958 - RNA, 19 nt, Artificial Sequence
  Description of Artificial Sequence: Synthetic oligonucleotide
  modified_base (1)..(1): a, c, u, g, unknown or other
nggugugcuucaguagaca

SEQ ID NO: 1959 - RNA, 19 nt, Artificial Sequence
  Description of Artificial Sequence: Synthetic oligonucleotide
  modified_base (1)..(1): a, c, u, g, unknown or other
nggacagagggccucccga

SEQ ID NO: 1960 - RNA, 19 nt, Artificial Sequence
  Description of Artificial Sequence: Synthetic oligonucleotide
  modified_base (1)..(1): a, c, u, g, unknown or other
naagaaaaucauccugaaa

SEQ ID NO: 1961 - RNA, 19 nt, Artificial Sequence
  Description of Artificial Sequence: Synthetic oligonucleotide
  modified_base (1)..(1): a, c, u, g, unknown or other
nugagauucuuugggccau

SEQ ID NO: 1962 - RNA, 19 nt, Artificial Sequence
  Description of Artificial Sequence: Synthetic oligonucleotide
  modified_base (1)..(1): a, c, u, g, unknown or other
nauguuuuaaggagacaaa

SEQ ID NO: 1963 - RNA, 19 nt, Artificial Sequence
  Description of Artificial Sequence: Synthetic oligonucleotide
  modified_base (1)..(1): a, c, u, g, unknown or other
ncacaguuucuggcaggcc

SEQ ID NO: 1964 - RNA, 19 nt, Artificial Sequence
  Description of Artificial Sequence: Synthetic oligonucleotide
  modified_base (1)..(1): a, c, u, g, unknown or other
nacaauauccaguucuucu

SEQ ID NO: 1965 - RNA, 19 nt, Artificial Sequence
  Description of Artificial Sequence: Synthetic oligonucleotide
  modified_base (1)..(1): a, c, u, g, unknown or other
nacauucaccagaaacuga

SEQ ID NO: 1966 - RNA, 19 nt, Artificial Sequence
  Description of Artificial Sequence: Synthetic oligonucleotide
  modified_base (1)..(1): a, c, u, g, unknown or other
ncaaggcaauaucauaccc

SEQ ID NO: 1967 - RNA, 19 nt, Artificial Sequence
  Description of Artificial Sequence: Synthetic oligonucleotide
  modified_base (1)..(1): a, c, u, g, unknown or other
ncuccaacgauccugggcu

SEQ ID NO: 1968 - RNA, 19 nt, Artificial Sequence
  Description of Artificial Sequence: Synthetic oligonucleotide
  modified_base (1)..(1): a, c, u, g, unknown or other
ncugaaaccagaaagagcu

SEQ ID NO: 1969 - RNA, 19 nt, Artificial Sequence
  Description of Artificial Sequence: Synthetic oligonucleotide
  modified_base (1)..(1): a, c, u, g, unknown or other
naaucucccuugcaagcgu

SEQ ID NO: 1970 - RNA, 19 nt, Artificial Sequence
  Description of Artificial Sequence: Synthetic oligonucleotide
  modified_base (1)..(1): a, c, u, g, unknown or other
nuguguaauucacuguggu

SEQ ID NO: 1971 - RNA, 19 nt, Artificial Sequence
  Description of Artificial Sequence: Synthetic oligonucleotide
  modified_base (1)..(1): a, c, u, g, unknown or other
nuuucagugaaaauccaga

SEQ ID NO: 1972 - RNA, 19 nt, Artificial Sequence
  Description of Artificial Sequence: Synthetic oligonucleotide
  modified_base (1)..(1): a, c, u, g, unknown or other
naaaucauccugaaaagac

SEQ ID NO: 1973 - RNA, 19 nt, Artificial Sequence
  Description of Artificial Sequence: Synthetic oligonucleotide
  modified_base (1)..(1): a, c, u, g, unknown or other
nuacacucauuauccauuu

SEQ ID NO: 1974 - RNA, 19 nt, Artificial Sequence
  Description of Artificial Sequence: Synthetic oligonucleotide
  modified_base (1)..(1): a, c, u, g, unknown or other
nuuggcaguguuucuguaa

SEQ ID NO: 1975 - RNA, 19 nt, Artificial Sequence
  Description of Artificial Sequence: Synthetic oligonucleotide
  modified_base (1)..(1): a, c, u, g, unknown or other
ngguacacucauuauccau

SEQ ID NO: 1976 - RNA, 19 nt, Artificial Sequence
  Description of Artificial Sequence: Synthetic oligonucleotide
  modified_base (1)..(1): a, c, u, g, unknown or other
naggcaggcauaugggucg

SEQ ID NO: 1977 - RNA, 19 nt, Artificial Sequence
  Description of Artificial Sequence: Synthetic oligonucleotide
  modified_base (1)..(1): a, c, u, g, unknown or other
nccaguuucaacaaggcaa

SEQ ID NO: 1978 - RNA, 19 nt, Artificial Sequence
  Description of Artificial Sequence: Synthetic oligonucleotide
  modified_base (1)..(1): a, c, u, g, unknown or other
nuggccgcucccuuugagc

SEQ ID NO: 1979 - RNA, 19 nt, Artificial Sequence
  Description of Artificial Sequence: Synthetic oligonucleotide
  modified_base (1)..(1): a, c, u, g, unknown or other
nacugugguuuccaguuuc

SEQ ID NO: 1980 - RNA, 19 nt, Artificial Sequence
  Description of Artificial Sequence: Synthetic oligonucleotide
  modified_base (1)..(1): a, c, u, g, unknown or other
ncuuugggccauuccuggg

SEQ ID NO: 1981 - RNA, 19 nt, Artificial Sequence
  Description of Artificial Sequence: Synthetic oligonucleotide
  modified_base (1)..(1): a, c, u, g, unknown or other
nuaagaaaaucauccugaa

SEQ ID NO: 1982 - RNA, 19 nt, Artificial Sequence
  Description of Artificial Sequence: Synthetic oligonucleotide
  modified_base (1)..(1): a, c, u, g, unknown or other
ncucuuuuauuucagauug

SEQ ID NO: 1983 - RNA, 19 nt, Artificial Sequence
  Description of Artificial Sequence: Synthetic oligonucleotide
  modified_base (1)..(1): a, c, u, g, unknown or other
nucuuugagauucuuuggg

SEQ ID NO: 1984 - RNA, 19 nt, Artificial Sequence
  Description of Artificial Sequence: Synthetic oligonucleotide
  modified_base (1)..(1): a, c, u, g, unknown or other
naaugauggagccuccaca

SEQ ID NO: 1985 - RNA, 19 nt, Artificial Sequence
  Description of Artificial Sequence: Synthetic oligonucleotide
  modified_base (1)..(1): a, c, u, g, unknown or other
ngaagaauggcagaacacu

SEQ ID NO: 1986 - RNA, 19 nt, Artificial Sequence
  Description of Artificial Sequence: Synthetic oligonucleotide
  modified_base (1)..(1): a, c, u, g, unknown or other
ncaaugauggagccuccac

SEQ ID NO: 1987 - RNA, 19 nt, Artificial Sequence
  Description of Artificial Sequence: Synthetic oligonucleotide
  modified_base (1)..(1): a, c, u, g, unknown or other
nauggagccuccacacagg

SEQ ID NO: 1988 - RNA, 19 nt, Artificial Sequence
  Description of Artificial Sequence: Synthetic oligonucleotide
  modified_base (1)..(1): a, c, u, g, unknown or other
ncccaagaaaucaguguca

SEQ ID NO: 1989 - RNA, 19 nt, Artificial Sequence
  Description of Artificial Sequence: Synthetic oligonucleotide
  modified_base (1)..(1): a, c, u, g, unknown or other
ngagccuccacacaggugu

SEQ ID NO: 1990 - RNA, 19 nt, Artificial Sequence
  Description of Artificial Sequence: Synthetic oligonucleotide
  modified_base (1)..(1): a, c, u, g, unknown or other
ncucccaagaaaucagugu

SEQ ID NO: 1991 - RNA, 19 nt, Artificial Sequence
  Description of Artificial Sequence: Synthetic oligonucleotide
  modified_base (1)..(1): a, c, u, g, unknown or other
nccuccacacaggugucuc

SEQ ID NO: 1992 - RNA, 19 nt, Artificial Sequence
  Description of Artificial Sequence: Synthetic oligonucleotide
  modified_base (1)..(1): a, c, u, g, unknown or other
nccaaugauggagccucca

SEQ ID NO: 1993 - RNA, 19 nt, Artificial Sequence
  Description of Artificial Sequence: Synthetic oligonucleotide
  modified_base (1)..(1): a, c, u, g, unknown or other
nuuuccaaugauggagccu

SEQ ID NO: 1994 - RNA, 19 nt, Artificial Sequence
  Description of Artificial Sequence: Synthetic oligonucleotide
  modified_base (1)..(1): a, c, u, g, unknown or other
nucccaagaaaucaguguc

SEQ ID NO: 1995 - RNA, 19 nt, Artificial Sequence
  Description of Artificial Sequence: Synthetic oligonucleotide
  modified_base (1)..(1): a, c, u, g, unknown or other
nagccuccacacagguguc

SEQ ID NO: 1996 - RNA, 19 nt, Artificial Sequence
  Description of Artificial Sequence: Synthetic oligonucleotide
  modified_base (1)..(1): a, c, u, g, unknown or other
nucuucucccaagaaauca

SEQ ID NO: 1997 - RNA, 19 nt, Artificial Sequence
  Description of Artificial Sequence: Synthetic oligonucleotide
  modified_base (1)..(1): a, c, u, g, unknown or other
nguuuccaaugauggagcc

SEQ ID NO: 1998 - RNA, 19 nt, Artificial Sequence
  Description of Artificial Sequence: Synthetic oligonucleotide
  modified_base (1)..(1): a, c, u, g, unknown or other
nuccaaugauggagccucc

SEQ ID NO: 1999 - RNA, 19 nt, Artificial Sequence
  Description of Artificial Sequence: Synthetic oligonucleotide
  modified_base (1)..(1): a, c, u, g, unknown or other
nuggagccuccacacaggu

SEQ ID NO: 2000 - RNA, 19 nt, Artificial Sequence
  Description of Artificial Sequence: Synthetic oligonucleotide
  modified_base (1)..(1): a, c, u, g, unknown or other
ngccuccacacaggugucu

SEQ ID NO: 2001 - RNA, 15 nt, Artificial Sequence
  Description of Artificial Sequence: Synthetic oligonucleotide
  modified_base (15)..(15): a, c, u, g, unknown or other
caccuaagauuuugn

SEQ ID NO: 2002 - RNA, 15 nt, Artificial Sequence
  Description of Artificial Sequence: Synthetic oligonucleotide
  modified_base (15)..(15): a, c, u, g, unknown or other
cauuuuaaaucaaun

SEQ ID NO: 2003 - RNA, 15 nt, Artificial Sequence
  Description of Artificial Sequence: Synthetic oligonucleotide
  modified_base (15)..(15): a, c, u, g, unknown or other
cagcagcgauuucun

SEQ ID NO: 2004 - RNA, 15 nt, Artificial Sequence
  Description of Artificial Sequence: Synthetic oligonucleotide
  modified_base (15)..(15): a, c, u, g, unknown or other
gaugauuuucuuaun

SEQ ID NO: 2005 - RNA, 15 nt, Artificial Sequence
  Description of Artificial Sequence: Synthetic oligonucleotide
  modified_base (15)..(15): a, c, u, g, unknown or other
cuaauacgguguuun

SEQ ID NO: 2006 - RNA, 15 nt, Artificial Sequence
  Description of Artificial Sequence: Synthetic oligonucleotide
  modified_base (15)..(15): a, c, u, g, unknown or other
caugacacugauuun

SEQ ID NO: 2007 - RNA, 15 nt, Artificial Sequence
  Description of Artificial Sequence: Synthetic oligonucleotide
  modified_base (15)..(15): a, c, u, g, unknown or other
cagaaagcggguaun

SEQ ID NO: 2008 - RNA, 15 nt, Artificial Sequence
  Description of Artificial Sequence: Synthetic oligonucleotide
  modified_base (15)..(15): a, c, u, g, unknown or other
uccuuaaaacaucun

SEQ ID NO: 2009 - RNA, 15 nt, Artificial Sequence
  Description of Artificial Sequence: Synthetic oligonucleotide
  modified_base (15)..(15): a, c, u, g, unknown or other
aaagccaagauaccn

SEQ ID NO: 2010 - RNA, 15 nt, Artificial Sequence
  Description of Artificial Sequence: Synthetic oligonucleotide
  modified_base (15)..(15): a, c, u, g, unknown or other
gaagagauacagagn

SEQ ID NO: 2011 - RNA, 15 nt, Artificial Sequence
  Description of Artificial Sequence: Synthetic oligonucleotide
  modified_base (15)..(15): a, c, u, g, unknown or other
aaauaauaauccaun

SEQ ID NO: 2012 - RNA, 15 nt, Artificial Sequence
  Description of Artificial Sequence: Synthetic oligonucleotide
  modified_base (15)..(15): a, c, u, g, unknown or other
uuucuaaucuggcun

SEQ ID NO: 2013 - RNA, 15 nt, Artificial Sequence
  Description of Artificial Sequence: Synthetic oligonucleotide
  modified_base (15)..(15): a, c, u, g, unknown or other
caaugccguccgcun

SEQ ID NO: 2014 - RNA, 15 nt, Artificial Sequence
  Description of Artificial Sequence: Synthetic oligonucleotide
aaucaaucugaaaua

SEQ ID NO: 2015 - RNA, 15 nt, Artificial Sequence
  Description of Artificial Sequence: Synthetic oligonucleotide
  modified_base (15)..(15): a, c, u, g, unknown or other
aaacuaagagacaan

SEQ ID NO: 2016 - RNA, 15 nt, Artificial Sequence
  Description of Artificial Sequence: Synthetic oligonucleotide
  modified_base (15)..(15): a, c, u, g, unknown or other
caucccaguguucun

SEQ ID NO: 2017 - RNA, 15 nt, Artificial Sequence
  Description of Artificial Sequence: Synthetic oligonucleotide
  modified_base (15)..(15): a, c, u, g, unknown or other
cuuauaucaaguggn

SEQ ID NO: 2018 - RNA, 15 nt, Artificial Sequence
  Description of Artificial Sequence: Synthetic oligonucleotide
  modified_base (15)..(15): a, c, u, g, unknown or other
uuuguaagaaaaugn

SEQ ID NO: 2019 - RNA, 15 nt, Artificial Sequence
  Description of Artificial Sequence: Synthetic oligonucleotide
  modified_base (15)..(15): a, c, u, g, unknown or other
caguacacgcauuan

SEQ ID NO: 2020 - RNA, 15 nt, Artificial Sequence
  Description of Artificial Sequence: Synthetic oligonucleotide
  modified_base (15)..(15): a, c, u, g, unknown or other
aggcccucuguccun

SEQ ID NO: 2021 - RNA, 15 nt, Artificial Sequence
  Description of Artificial Sequence: Synthetic oligonucleotide
  modified_base (15)..(15): a, c, u, g, unknown or other
caucaucccgguugn

SEQ ID NO: 2022 - RNA, 15 nt, Artificial Sequence
  Description of Artificial Sequence: Synthetic oligonucleotide
  modified_base (15)..(15): a, c, u, g, unknown or other
aagaaaucuuugucn

SEQ ID NO: 2023 - RNA, 15 nt, Artificial Sequence
  Description of Artificial Sequence: Synthetic oligonucleotide
  modified_base (15)..(15): a, c, u, g, unknown or other
cagcaugcuuccucn

SEQ ID NO: 2024 - RNA, 15 nt, Artificial Sequence
  Description of Artificial Sequence: Synthetic oligonucleotide
  modified_base (15)..(15): a, c, u, g, unknown or other
uagggacauuuuccn

SEQ ID NO: 2025 - RNA, 15 nt, Artificial Sequence
  Description of Artificial Sequence: Synthetic oligonucleotide
  modified_base (15)..(15): a, c, u, g, unknown or other
caaguguuacuuaan

SEQ ID NO: 2026 - RNA, 15 nt, Artificial Sequence
  Description of Artificial Sequence: Synthetic oligonucleotide
  modified_base (15)..(15): a, c, u, g, unknown or other
cggguaugauauugn

SEQ ID NO: 2027 - RNA, 15 nt, Artificial Sequence
  Description of Artificial Sequence: Synthetic oligonucleotide
  modified_base (15)..(15): a, c, u, g, unknown or other
caagugguacauuun

SEQ ID NO: 2028 - RNA, 15 nt, Artificial Sequence
  Description of Artificial Sequence: Synthetic oligonucleotide
  modified_base (15)..(15): a, c, u, g, unknown or other
caggaugauuuucun

SEQ ID NO: 2029 - RNA, 15 nt, Artificial Sequence
  Description of Artificial Sequence: Synthetic oligonucleotide
  modified_base (15)..(15): a, c, u, g, unknown or other
aagggcaaguguuan

SEQ ID NO: 2030 - RNA, 15 nt, Artificial Sequence
  Description of Artificial Sequence: Synthetic oligonucleotide
  modified_base (15)..(15): a, c, u, g, unknown or other
uguaagaaaaugcun

SEQ ID NO: 2031 - RNA, 15 nt, Artificial Sequence
  Description of Artificial Sequence: Synthetic oligonucleotide
  modified_base (15)..(15): a, c, u, g, unknown or other
uaauacgguguuugn

SEQ ID NO: 2032 - RNA, 15 nt, Artificial Sequence
  Description of Artificial Sequence: Synthetic oligonucleotide
  modified_base (15)..(15): a, c, u, g, unknown or other
uauuaacagccgcun

SEQ ID NO: 2033 - RNA, 15 nt, Artificial Sequence
  Description of Artificial Sequence: Synthetic oligonucleotide
  modified_base (15)..(15): a, c, u, g, unknown or other
auuaacagccgcucn

SEQ ID NO: 2034 - RNA, 15 nt, Artificial Sequence
  Description of Artificial Sequence: Synthetic oligonucleotide
  modified_base (15)..(15): a, c, u, g, unknown or other
gaaaucuuugucucn

SEQ ID NO: 2035 - RNA, 15 nt, Artificial Sequence
  Description of Artificial Sequence: Synthetic oligonucleotide
  modified_base (15)..(15): a, c, u, g, unknown or other
cauaaaauaacccan

SEQ ID NO: 2036 - RNA, 15 nt, Artificial Sequence
  Description of Artificial Sequence: Synthetic oligonucleotide
  modified_base (15)..(15): a, c, u, g, unknown or other
cagugucauggcucn

SEQ ID NO: 2037 - RNA, 15 nt, Artificial Sequence
  Description of Artificial Sequence: Synthetic oligonucleotide
  modified_base (15)..(15): a, c, u, g, unknown or other
cacuuucuaaucugn

SEQ ID NO: 2038 - RNA, 15 nt, Artificial Sequence
  Description of Artificial Sequence: Synthetic oligonucleotide
  modified_base (15)..(15): a, c, u, g, unknown or other
uuucuggguauucun

SEQ ID NO: 2039 - RNA, 15 nt, Artificial Sequence
  Description of Artificial Sequence: Synthetic oligonucleotide
  modified_base (15)..(15): a, c, u, g, unknown or other
ccuuaaaacaucugn

SEQ ID NO: 2040 - RNA, 15 nt, Artificial Sequence
  Description of Artificial Sequence: Synthetic oligonucleotide
  modified_base (15)..(15): a, c, u, g, unknown or other
caucucuggauacan

SEQ ID NO: 2041 - RNA, 15 nt, Artificial Sequence
  Description of Artificial Sequence: Synthetic oligonucleotide
  modified_base (15)..(15): a, c, u, g, unknown or other
ugaaugugugacucn

SEQ ID NO: 2042 - RNA, 15 nt, Artificial Sequence
  Description of Artificial Sequence: Synthetic oligonucleotide
  modified_base (15)..(15): a, c, u, g, unknown or other
cacaucuuucuuugn

SEQ ID NO: 2043 - RNA, 15 nt, Artificial Sequence
  Description of Artificial Sequence: Synthetic oligonucleotide
  modified_base (15)..(15): a, c, u, g, unknown or other
uuauaucaaguggun

SEQ ID NO: 2044 - RNA, 15 nt, Artificial Sequence
  Description of Artificial Sequence: Synthetic oligonucleotide
  modified_base (15)..(15): a, c, u, g, unknown or other
cuuaaagcuuucuun

SEQ ID NO: 2045 - RNA, 15 nt, Artificial Sequence
  Description of Artificial Sequence: Synthetic oligonucleotide
  modified_base (15)..(15): a, c, u, g, unknown or other
ucaaucugaaauaan

SEQ ID NO: 2046 - RNA, 15 nt, Artificial Sequence
  Description of Artificial Sequence: Synthetic oligonucleotide
  modified_base (15)..(15): a, c, u, g, unknown or other
caaugcucacaccan

SEQ ID NO: 2047 - RNA, 15 nt, Artificial Sequence
  Description of Artificial Sequence: Synthetic oligonucleotide
  modified_base (15)..(15): a, c, u, g, unknown or other
cuuuucaggaugaun

SEQ ID NO: 2048 - RNA, 15 nt, Artificial Sequence
  Description of Artificial Sequence: Synthetic oligonucleotide
  modified_base (15)..(15): a, c, u, g, unknown or other
caagcaaugcucacn

SEQ ID NO: 2049 - RNA, 15 nt, Artificial Sequence
  Description of Artificial Sequence: Synthetic oligonucleotide
  modified_base (15)..(15): a, c, u, g, unknown or other
cagaagagauacagn

SEQ ID NO: 2050 - RNA, 15 nt, Artificial Sequence
  Description of Artificial Sequence: Synthetic oligonucleotide
  modified_base (15)..(15): a, c, u, g, unknown or other
auacacauuaaggun

SEQ ID NO: 2051 - RNA, 15 nt, Artificial Sequence
  Description of Artificial Sequence: Synthetic oligonucleotide
  modified_base (15)..(15): a, c, u, g, unknown or other
uaauaauccaugaun

SEQ ID NO: 2052 - RNA, 15 nt, Artificial Sequence
  Description of Artificial Sequence: Synthetic oligonucleotide
  modified_base (15)..(15): a, c, u, g, unknown or other
caaagaaaucuuugn

SEQ ID NO: 2053 - RNA, 15 nt, Artificial Sequence
  Description of Artificial Sequence: Synthetic oligonucleotide
  modified_base (15)..(15): a, c, u, g, unknown or other
aacuaaaauacuucn

SEQ ID NO: 2054 - RNA, 15 nt, Artificial Sequence
  Description of Artificial Sequence: Synthetic oligonucleotide
  modified_base (15)..(15): a, c, u, g, unknown or other
uuuuaaaucaaucun

SEQ ID NO: 2055 - RNA, 15 nt, Artificial Sequence
  Description of Artificial Sequence: Synthetic oligonucleotide
  modified_base (15)..(15): a, c, u, g, unknown or other
aagccaagauacccn

SEQ ID NO: 2056 - RNA, 15 nt, Artificial Sequence
  Description of Artificial Sequence: Synthetic oligonucleotide
  modified_base (15)..(15): a, c, u, g, unknown or other
aaucuuugucuccun

SEQ ID NO: 2057 - RNA, 15 nt, Artificial Sequence
  Description of Artificial Sequence: Synthetic oligonucleotide
  modified_base (15)..(15): a, c, u, g, unknown or other
cauuuuaccaugacn

SEQ ID NO: 2058 - RNA, 15 nt, Artificial Sequence
  Description of Artificial Sequence: Synthetic oligonucleotide
  modified_base (15)..(15): a, c, u, g, unknown or other
gaagaacuggauaun

SEQ ID NO: 2059 - RNA, 15 nt, Artificial Sequence
  Description of Artificial Sequence: Synthetic oligonucleotide
  modified_base (15)..(15): a, c, u, g, unknown or other
aagaacuggauauun

SEQ ID NO: 2060 - RNA, 15 nt, Artificial Sequence
  Description of Artificial Sequence: Synthetic oligonucleotide
  modified_base (15)..(15): a, c, u, g, unknown or other
acuggaaaccacagn

SEQ ID NO: 2061 - RNA, 15 nt, Artificial Sequence
  Description of Artificial Sequence: Synthetic oligonucleotide
  modified_base (15)..(15): a, c, u, g, unknown or other
gcacuuucuaaucun

SEQ ID NO: 2062 - RNA, 15 nt, Artificial Sequence
  Description of Artificial Sequence: Synthetic oligonucleotide
  modified_base (15)..(15): a, c, u, g, unknown or other
ugacacugauuucun

SEQ ID NO: 2063 - RNA, 15 nt, Artificial Sequence
  Description of Artificial Sequence: Synthetic oligonucleotide
  modified_base (15)..(15): a, c, u, g, unknown or other
gaaauaauaauccan

SEQ ID NO: 2064 - RNA, 15 nt, Artificial Sequence
  Description of Artificial Sequence: Synthetic oligonucleotide
  modified_base (15)..(15): a, c, u, g, unknown or other
acuuucuaaucuggn

SEQ ID NO: 2065 - RNA, 15 nt, Artificial Sequence
  Description of Artificial Sequence: Synthetic oligonucleotide
  modified_base (15)..(15): a, c, u, g, unknown or other
aaauggauaaugagn

SEQ ID NO: 2066 - RNA, 15 nt, Artificial Sequence
  Description of Artificial Sequence: Synthetic oligonucleotide
  modified_base (15)..(15): a, c, u, g, unknown or other
caggaauggcccaan

SEQ ID NO: 2067 - RNA, 15 nt, Artificial Sequence
  Description of Artificial Sequence: Synthetic oligonucleotide
  modified_base (15)..(15): a, c, u, g, unknown or other
caaaaucaagcccan

SEQ ID NO: 2068 - RNA, 15 nt, Artificial Sequence
  Description of Artificial Sequence: Synthetic oligonucleotide
  modified_base (15)..(15): a, c, u, g, unknown or other
uuuaaaucaaucugn

SEQ ID NO: 2069 - RNA, 15 nt, Artificial Sequence
  Description of Artificial Sequence: Synthetic oligonucleotide
  modified_base (15)..(15): a, c, u, g, unknown or other
caucccgguugcuun

SEQ ID NO: 2070 - RNA, 15 nt, Artificial Sequence
  Description of Artificial Sequence: Synthetic oligonucleotide
  modified_base (15)..(15): a, c, u, g, unknown or other
ggauacacauuaagn

SEQ ID NO: 2071 - RNA, 15 nt, Artificial Sequence
  Description of Artificial Sequence: Synthetic oligonucleotide
  modified_base (15)..(15): a, c, u, g, unknown or other
ccacagugaauuacn

SEQ ID NO: 2072 - RNA, 15 nt, Artificial Sequence
  Description of Artificial Sequence: Synthetic oligonucleotide
  modified_base (15)..(15): a, c, u, g, unknown or other
ggagauagaaaugun

SEQ ID NO: 2073 - RNA, 15 nt, Artificial Sequence
  Description of Artificial Sequence: Synthetic oligonucleotide
  modified_base (15)..(15): a, c, u, g, unknown or other
auuggaaaccagugn

SEQ ID NO: 2074 - RNA, 15 nt, Artificial Sequence
  Description of Artificial Sequence: Synthetic oligonucleotide
  modified_base (15)..(15): a, c, u, g, unknown or other
aauuacacagauucn

SEQ ID NO: 2075 - RNA, 15 nt, Artificial Sequence
  Description of Artificial Sequence: Synthetic oligonucleotide
  modified_base (15)..(15): a, c, u, g, unknown or other
agagugaauaggacn

SEQ ID NO: 2076 - RNA, 15 nt, Artificial Sequence
  Description of Artificial Sequence: Synthetic oligonucleotide
  modified_base (15)..(15): a, c, u, g, unknown or other
uuucaagcaaugcun

SEQ ID NO: 2077 - RNA, 15 nt, Artificial Sequence
  Description of Artificial Sequence: Synthetic oligonucleotide
  modified_base (15)..(15): a, c, u, g, unknown or other
gauuucuggguauun

SEQ ID NO: 2078 - RNA, 15 nt, Artificial Sequence
  Description of Artificial Sequence: Synthetic oligonucleotide
  modified_base (15)..(15): a, c, u, g, unknown or other
caagaaauaauaaun

SEQ ID NO: 2079 - RNA, 15 nt, Artificial Sequence
  Description of Artificial Sequence: Synthetic oligonucleotide
  modified_base (15)..(15): a, c, u, g, unknown or other
caacuaaaauacuun

SEQ ID NO: 2080 - RNA, 15 nt, Artificial Sequence
  Description of Artificial Sequence: Synthetic oligonucleotide
  modified_base (15)..(15): a, c, u, g, unknown or other
cguggacuggauucn

SEQ ID NO: 2081 - RNA, 15 nt, Artificial Sequence
  Description of Artificial Sequence: Synthetic oligonucleotide
  modified_base (15)..(15): a, c, u, g, unknown or other
agaaaucuuugucun

SEQ ID NO: 2082 - RNA, 15 nt, Artificial Sequence
  Description of Artificial Sequence: Synthetic oligonucleotide
  modified_base (15)..(15): a, c, u, g, unknown or other
cacugaaauccugun

SEQ ID NO: 2083 - RNA, 15 nt, Artificial Sequence
  Description of Artificial Sequence: Synthetic oligonucleotide
  modified_base (15)..(15): a, c, u, g, unknown or other
gauauugccuuguun

SEQ ID NO: 2084 - RNA, 15 nt, Artificial Sequence
  Description of Artificial Sequence: Synthetic oligonucleotide
  modified_base (15)..(15): a, c, u, g, unknown or other
uaugauauugccuun

SEQ ID NO: 2085 - RNA, 15 nt, Artificial Sequence
  Description of Artificial Sequence: Synthetic oligonucleotide
  modified_base (15)..(15): a, c, u, g, unknown or other
cgauuucuggguaun

SEQ ID NO: 2086 - RNA, 15 nt, Artificial Sequence
  Description of Artificial Sequence: Synthetic oligonucleotide
  modified_base (15)..(15): a, c, u, g, unknown or other
auuuuaaaucaaucn

SEQ ID NO: 2087 - RNA, 15 nt, Artificial Sequence
  Description of Artificial Sequence: Synthetic oligonucleotide
  modified_base (15)..(15): a, c, u, g, unknown or other
caagagugaauaggn

SEQ ID NO: 2088 - RNA, 15 nt, Artificial Sequence
  Description of Artificial Sequence: Synthetic oligonucleotide
  modified_base (15)..(15): a, c, u, g, unknown or other
uuuugcgugucuacn

SEQ ID NO: 2089 - RNA, 15 nt, Artificial Sequence
  Description of Artificial Sequence: Synthetic oligonucleotide
  modified_base (15)..(15): a, c, u, g, unknown or other
cuggagaaaacucan

SEQ ID NO: 2090 - RNA, 15 nt, Artificial Sequence
  Description of Artificial Sequence: Synthetic oligonucleotide
  modified_base (15)..(15): a, c, u, g, unknown or other
aaucucaaagaaaun

SEQ ID NO: 2091 - RNA, 15 nt, Artificial Sequence
  Description of Artificial Sequence: Synthetic oligonucleotide
  modified_base (15)..(15): a, c, u, g, unknown or other
augauuuucuuauan

SEQ ID NO: 2092 - RNA, 15 nt, Artificial Sequence
  Description of Artificial Sequence: Synthetic oligonucleotide
  modified_base (15)..(15): a, c, u, g, unknown or other
ucaccuaagauuuun

SEQ ID NO: 2093 - RNA, 15 nt, Artificial Sequence
  Description of Artificial Sequence: Synthetic oligonucleotide
  modified_base (15)..(15): a, c, u, g, unknown or other
cagcaucccagugun

SEQ ID NO: 2094 - RNA, 15 nt, Artificial Sequence
  Description of Artificial Sequence: Synthetic oligonucleotide
  modified_base (15)..(15): a, c, u, g, unknown or other
ugaaauccugugcan

SEQ ID NO: 2095 - RNA, 15 nt, Artificial Sequence
  Description of Artificial Sequence: Synthetic oligonucleotide
  modified_base (15)..(15): a, c, u, g, unknown or other
aaucuggcuuguaun

SEQ ID NO: 2096 - RNA, 15 nt, Artificial Sequence
  Description of Artificial Sequence: Synthetic oligonucleotide
  modified_base (15)..(15): a, c, u, g, unknown or other
aacuggaaaccacan

SEQ ID NO: 2097 - RNA, 15 nt, Artificial Sequence
  Description of Artificial Sequence: Synthetic oligonucleotide
  modified_base (15)..(15): a, c, u, g, unknown or other
cgaagggaagggcan

SEQ ID NO: 2098 - RNA, 15 nt, Artificial Sequence
  Description of Artificial Sequence: Synthetic oligonucleotide
  modified_base (15)..(15): a, c, u, g, unknown or other
uucaggaugauuuun

SEQ ID NO: 2099 - RNA, 15 nt, Artificial Sequence
  Description of Artificial Sequence: Synthetic oligonucleotide
  modified_base (15)..(15): a, c, u, g, unknown or other
cacugauuucuuggn

SEQ ID NO: 2100 - RNA, 15 nt, Artificial Sequence
  Description of Artificial Sequence: Synthetic oligonucleotide
  modified_base (15)..(15): a, c, u, g, unknown or other
acgacccauaugccn

SEQ ID NO: 2101 - RNA, 15 nt, Artificial Sequence
  Description of Artificial Sequence: Synthetic oligonucleotide
  modified_base (15)..(15): a, c, u, g, unknown or other
auuacacagauucun

SEQ ID NO: 2102 - RNA, 15 nt, Artificial Sequence
  Description of Artificial Sequence: Synthetic oligonucleotide
  modified_base (15)..(15): a, c, u, g, unknown or other
uacguggacuggaun

SEQ ID NO: 2103 - RNA, 15 nt, Artificial Sequence
  Description of Artificial Sequence: Synthetic oligonucleotide
  modified_base (15)..(15): a, c, u, g, unknown or other
aagagauacagaggn

SEQ ID NO: 2104 - RNA, 15 nt, Artificial Sequence
  Description of Artificial Sequence: Synthetic oligonucleotide
  modified_base (15)..(15): a, c, u, g, unknown or other
cugaaauccugugcn

SEQ ID NO: 2105 - RNA, 15 nt, Artificial Sequence
  Description of Artificial Sequence: Synthetic oligonucleotide
  modified_base (15)..(15): a, c, u, g, unknown or other
auucuucauuuuacn

SEQ ID NO: 2106 - RNA, 15 nt, Artificial Sequence
  Description of Artificial Sequence: Synthetic oligonucleotide
  modified_base (15)..(15): a, c, u, g, unknown or other
agauucucaacgacn

SEQ ID NO: 2107 - RNA, 15 nt, Artificial Sequence
  Description of Artificial Sequence: Synthetic oligonucleotide
  modified_base (15)..(15): a, c, u, g, unknown or other
cuggauauuguugcn

SEQ ID NO: 2108 - RNA, 15 nt, Artificial Sequence
  Description of Artificial Sequence: Synthetic oligonucleotide
  modified_base (15)..(15): a, c, u, g, unknown or other
aaugccguccgcugn

SEQ ID NO: 2109 - RNA, 15 nt, Artificial Sequence
  Description of Artificial Sequence: Synthetic oligonucleotide
  modified_base (15)..(15): a, c, u, g, unknown or other
uacuuaaagcuuucn

SEQ ID NO: 2110 - RNA, 15 nt, Artificial Sequence
  Description of Artificial Sequence: Synthetic oligonucleotide
  modified_base (15)..(15): a, c, u, g, unknown or other
uacagaaacacugcn

SEQ ID NO: 2111 - RNA, 15 nt, Artificial Sequence
  Description of Artificial Sequence: Synthetic oligonucleotide
  modified_base (15)..(15): a, c, u, g, unknown or other
uuacacagauucucn

SEQ ID NO: 2112 - RNA, 15 nt, Artificial Sequence
  Description of Artificial Sequence: Synthetic oligonucleotide
  modified_base (15)..(15): a, c, u, g, unknown or other
guacguggacuggan

SEQ ID NO: 2113 - RNA, 15 nt, Artificial Sequence
  Description of Artificial Sequence: Synthetic oligonucleotide
  modified_base (15)..(15): a, c, u, g, unknown or other
aagcaaugcucacan

SEQ ID NO: 2114 - RNA, 15 nt, Artificial Sequence
  Description of Artificial Sequence: Synthetic oligonucleotide
  modified_base (15)..(15): a, c, u, g, unknown or other
acucaucaucccggn

SEQ ID NO: 2115 - RNA, 15 nt, Artificial Sequence
  Description of Artificial Sequence: Synthetic oligonucleotide
  modified_base (15)..(15): a, c, u, g, unknown or other
gcucgauaaaguggn

SEQ ID NO: 2116 - RNA, 15 nt, Artificial Sequence
  Description of Artificial Sequence: Synthetic oligonucleotide
  modified_base (15)..(15): a, c, u, g, unknown or other
uaaaauggauaaugn

SEQ ID NO: 2117 - RNA, 15 nt, Artificial Sequence
  Description of Artificial Sequence: Synthetic oligonucleotide
  modified_base (15)..(15): a, c, u, g, unknown or other
ucaucaucccgguun

SEQ ID NO: 2118 - RNA, 15 nt, Artificial Sequence
  Description of Artificial Sequence: Synthetic oligonucleotide
  modified_base (15)..(15): a, c, u, g, unknown or other
aauggcccaaagaan

SEQ ID NO: 2119 - RNA, 15 nt, Artificial Sequence
  Description of Artificial Sequence: Synthetic oligonucleotide
  modified_base (15)..(15): a, c, u, g, unknown or other
caagauacccuuagn

SEQ ID NO: 2120 - RNA, 15 nt, Artificial Sequence
  Description of Artificial Sequence: Synthetic oligonucleotide
  modified_base (15)..(15): a, c, u, g, unknown or other
aaugcucacaccaan

SEQ ID NO: 2121 - RNA, 15 nt, Artificial Sequence
  Description of Artificial Sequence: Synthetic oligonucleotide
  modified_base (15)..(15): a, c, u, g, unknown or other
caacgacccauaugn

SEQ ID NO: 2122 - RNA, 15 nt, Artificial Sequence
  Description of Artificial Sequence: Synthetic oligonucleotide
  modified_base (15)..(15): a, c, u, g, unknown or other
uggauacacauuaan

SEQ ID NO: 2123 - RNA, 15 nt, Artificial Sequence
  Description of Artificial Sequence: Synthetic oligonucleotide
  modified_base (15)..(15): a, c, u, g, unknown or other
cuuaaaacaucugan

SEQ ID NO: 2124 - RNA, 15 nt, Artificial Sequence
  Description of Artificial Sequence: Synthetic oligonucleotide
  modified_base (15)..(15): a, c, u, g, unknown or other
cuccaucauuggaan

SEQ ID NO: 2125 - RNA, 15 nt, Artificial Sequence
  Description of Artificial Sequence: Synthetic oligonucleotide
  modified_base (15)..(15): a, c, u, g, unknown or other
guggacuggauucun

SEQ ID NO: 2126 - RNA, 15 nt, Artificial Sequence
  Description of Artificial Sequence: Synthetic oligonucleotide
  modified_base (15)..(15): a, c, u, g, unknown or other
caaagaaucucaaan

SEQ ID NO: 2127 - RNA, 15 nt, Artificial Sequence
  Description of Artificial Sequence: Synthetic oligonucleotide
  modified_base (15)..(15): a, c, u, g, unknown or other
uuuucaggaugauun

SEQ ID NO: 2128 - RNA, 15 nt, Artificial Sequence
  Description of Artificial Sequence: Synthetic oligonucleotide
  modified_base (15)..(15): a, c, u, g, unknown or other
gauuuugcgugucun

SEQ ID NO: 2129 - RNA, 15 nt, Artificial Sequence
  Description of Artificial Sequence: Synthetic oligonucleotide
  modified_base (15)..(15): a, c, u, g, unknown or other
cguggucgaguacgn

SEQ ID NO: 2130 - RNA, 15 nt, Artificial Sequence
  Description of Artificial Sequence: Synthetic oligonucleotide
  modified_base (15)..(15): a, c, u, g, unknown or other
ugggugacuggaugn

SEQ ID NO: 2131 - RNA, 15 nt, Artificial Sequence
  Description of Artificial Sequence: Synthetic oligonucleotide
  modified_base (15)..(15): a, c, u, g, unknown or other
agcaucccaguguun

SEQ ID NO: 2132 - RNA, 15 nt, Artificial Sequence
  Description of Artificial Sequence: Synthetic oligonucleotide
  modified_base (15)..(15): a, c, u, g, unknown or other
caaagcucuuucugn

SEQ ID NO: 2133 - RNA, 15 nt, Artificial Sequence
  Description of Artificial Sequence: Synthetic oligonucleotide
  modified_base (15)..(15): a, c, u, g, unknown or other
agaaucucaaagaan

SEQ ID NO: 2134 - RNA, 15 nt, Artificial Sequence
  Description of Artificial Sequence: Synthetic oligonucleotide
  modified_base (15)..(15): a, c, u, g, unknown or other
uggauauuguugcun

SEQ ID NO: 2135 - RNA, 15 nt, Artificial Sequence
  Description of Artificial Sequence: Synthetic oligonucleotide
  modified_base (15)..(15): a, c, u, g, unknown or other
cucgauaaaguggun

SEQ ID NO: 2136 - RNA, 15 nt, Artificial Sequence
  Description of Artificial Sequence: Synthetic oligonucleotide
  modified_base (15)..(15): a, c, u, g, unknown or other
aacgaagggaagggn

SEQ ID NO: 2137 - RNA, 15 nt, Artificial Sequence
  Description of Artificial Sequence: Synthetic oligonucleotide
  modified_base (15)..(15): a, c, u, g, unknown or other
ccuaagauuuugcgn

SEQ ID NO: 2138 - RNA, 15 nt, Artificial Sequence
  Description of Artificial Sequence: Synthetic oligonucleotide
  modified_base (15)..(15): a, c, u, g, unknown or other
cacaguaacacgcun

SEQ ID NO: 2139 - RNA, 15 nt, Artificial Sequence
  Description of Artificial Sequence: Synthetic oligonucleotide
  modified_base (15)..(15): a, c, u, g, unknown or other
cuacagggaaggagn

SEQ ID NO: 2140 - RNA, 15 nt, Artificial Sequence
  Description of Artificial Sequence: Synthetic oligonucleotide
  modified_base (15)..(15): a, c, u, g, unknown or other
gagauacagaggacn

SEQ ID NO: 2141 - RNA, 15 nt, Artificial Sequence
  Description of Artificial Sequence: Synthetic oligonucleotide
  modified_base (15)..(15): a, c, u, g, unknown or other
gaaagccaagauacn

SEQ ID NO: 2142 - RNA, 15 nt, Artificial Sequence
  Description of Artificial Sequence: Synthetic oligonucleotide
  modified_base (15)..(15): a, c, u, g, unknown or other
aacacugccaagagn

SEQ ID NO: 2143 - RNA, 15 nt, Artificial Sequence
  Description of Artificial Sequence: Synthetic oligonucleotide
  modified_base (15)..(15): a, c, u, g, unknown or other
augacacugauuucn

SEQ ID NO: 2144 - RNA, 15 nt, Artificial Sequence
  Description of Artificial Sequence: Synthetic oligonucleotide
  modified_base (15)..(15): a, c, u, g, unknown or other
cggcuacagggaagn

SEQ ID NO: 2145 - RNA, 15 nt, Artificial Sequence
  Description of Artificial Sequence: Synthetic oligonucleotide
  modified_base (15)..(15): a, c, u, g, unknown or other
aagggagcggccagn

SEQ ID NO: 2146 - RNA, 15 nt, Artificial Sequence
  Description of Artificial Sequence: Synthetic oligonucleotide
  modified_base (15)..(15): a, c, u, g, unknown or other
uaagauuuugcgugn

SEQ ID NO: 2147 - RNA, 15 nt, Artificial Sequence
  Description of Artificial Sequence: Synthetic oligonucleotide
  modified_base (15)..(15): a, c, u, g, unknown or other
cucuuucugguuucn

SEQ ID NO: 2148 - RNA, 15 nt, Artificial Sequence
  Description of Artificial Sequence: Synthetic oligonucleotide
  modified_base (15)..(15): a, c, u, g, unknown or other
uuacuuaaagcuuun

SEQ ID NO: 2149 - RNA, 15 nt, Artificial Sequence
  Description of Artificial Sequence: Synthetic oligonucleotide
  modified_base (15)..(15): a, c, u, g, unknown or other
cuaaucuggcuugun

SEQ ID NO: 2150 - RNA, 15 nt, Artificial Sequence
  Description of Artificial Sequence: Synthetic oligonucleotide
  modified_base (15)..(15): a, c, u, g, unknown or other
aauggauaaugagun

SEQ ID NO: 2151 - RNA, 15 nt, Artificial Sequence
  Description of Artificial Sequence: Synthetic oligonucleotide
  modified_base (15)..(15): a, c, u, g, unknown or other
aaggucuuuucaggn

SEQ ID NO: 2152 - RNA, 15 nt, Artificial Sequence
  Description of Artificial Sequence: Synthetic oligonucleotide
  modified_base (15)..(15): a, c, u, g, unknown or other
caucauuggaaaccn

SEQ ID NO: 2153 - RNA, 15 nt, Artificial Sequence
  Description of Artificial Sequence: Synthetic oligonucleotide
  modified_base (15)..(15): a, c, u, g, unknown or other
ccugccagaaacugn

SEQ ID NO: 2154 - RNA, 15 nt, Artificial Sequence
  Description of Artificial Sequence: Synthetic oligonucleotide
  modified_base (15)..(15): a, c, u, g, unknown or other
caguguucugccaun

SEQ ID NO: 2155 - RNA, 15 nt, Artificial Sequence
  Description of Artificial Sequence: Synthetic oligonucleotide
  modified_base (15)..(15): a, c, u, g, unknown or other
ucucaaagaaaucun

SEQ ID NO: 2156 - RNA, 15 nt, Artificial Sequence
  Description of Artificial Sequence: Synthetic oligonucleotide
  modified_base (15)..(15): a, c, u, g, unknown or other
uugaaacuggaaacn

SEQ ID NO: 2157 - RNA, 15 nt, Artificial Sequence
  Description of Artificial Sequence: Synthetic oligonucleotide
  modified_base (15)..(15): a, c, u, g, unknown or other
agagauacagaggan

SEQ ID NO: 2158 - RNA, 15 nt, Artificial Sequence
  Description of Artificial Sequence: Synthetic oligonucleotide
  modified_base (15)..(15): a, c, u, g, unknown or other
gucuuuucaggaugn

SEQ ID NO: 2159 - RNA, 15 nt, Artificial Sequence
  Description of Artificial Sequence: Synthetic oligonucleotide
  modified_base (15)..(15): a, c, u, g, unknown or other
uggagaaaacucaan

SEQ ID NO: 2160 - RNA, 15 nt, Artificial Sequence
  Description of Artificial Sequence: Synthetic oligonucleotide
  modified_base (15)..(15): a, c, u, g, unknown or other
aaccacagugaauun

SEQ ID NO: 2161 - RNA, 15 nt, Artificial Sequence
  Description of Artificial Sequence: Synthetic oligonucleotide
  modified_base (15)..(15): a, c, u, g, unknown or other
cucaaagaaaucuun

SEQ ID NO: 2162 - RNA, 15 nt, Artificial Sequence
  Description of Artificial Sequence: Synthetic oligonucleotide
  modified_base (15)..(15): a, c, u, g, unknown or other
aaaucuuugucuccn

SEQ ID NO: 2163 - RNA, 15 nt, Artificial Sequence
  Description of Artificial Sequence: Synthetic oligonucleotide
  modified_base (15)..(15): a, c, u, g, unknown or other
ucaggaugauuuucn

SEQ ID NO: 2164 - RNA, 15 nt, Artificial Sequence
  Description of Artificial Sequence: Synthetic oligonucleotide
  modified_base (15)..(15): a, c, u, g, unknown or other
aaaauggcagaaagn

SEQ ID NO: 2165 - RNA, 15 nt, Artificial Sequence
  Description of Artificial Sequence: Synthetic oligonucleotide
  modified_base (15)..(15): a, c, u, g, unknown or other
cgaguacguggacun

SEQ ID NO: 2166 - RNA, 15 nt, Artificial Sequence
  Description of Artificial Sequence: Synthetic oligonucleotide
  modified_base (15)..(15): a, c, u, g, unknown or other
aguacacgcauuaan

SEQ ID NO: 2167 - RNA, 15 nt, Artificial Sequence
  Description of Artificial Sequence: Synthetic oligonucleotide
  modified_base (15)..(15): a, c, u, g, unknown or other
cuggauacacauuan

SEQ ID NO: 2168 - RNA, 15 nt, Artificial Sequence
  Description of Artificial Sequence: Synthetic oligonucleotide
  modified_base (15)..(15): a, c, u, g, unknown or other
uggcccaaagaaucn

SEQ ID NO: 2169 - RNA, 15 nt, Artificial Sequence
  Description of Artificial Sequence: Synthetic oligonucleotide
  modified_base (15)..(15): a, c, u, g, unknown or other
ucuuucugguuucan

SEQ ID NO: 2170 - RNA, 15 nt, Artificial Sequence
  Description of Artificial Sequence: Synthetic oligonucleotide
  modified_base (15)..(15): a, c, u, g, unknown or other
cuggugaaugugugn

SEQ ID NO: 2171 - RNA, 15 nt, Artificial Sequence
  Description of Artificial Sequence: Synthetic oligonucleotide
  modified_base (15)..(15): a, c, u, g, unknown or other
aaagaaaucuuugun

SEQ ID NO: 2172 - RNA, 15 nt, Artificial Sequence
  Description of Artificial Sequence: Synthetic oligonucleotide
  modified_base (15)..(15): a, c, u, g, unknown or other
aggagauagaaaugn

SEQ ID NO: 2173 - RNA, 15 nt, Artificial Sequence
  Description of Artificial Sequence: Synthetic oligonucleotide
  modified_base (15)..(15): a, c, u, g, unknown or other
caguguuacagaaan

SEQ ID NO: 2174 - RNA, 15 nt, Artificial Sequence
  Description of Artificial Sequence: Synthetic oligonucleotide
  modified_base (15)..(15): a, c, u, g, unknown or other
uuucacugaaauccn

SEQ ID NO: 2175 - RNA, 15 nt, Artificial Sequence
  Description of Artificial Sequence: Synthetic oligonucleotide
  modified_base (15)..(15): a, c, u, g, unknown or other
gcucaaagggagcgn

SEQ ID NO: 2176 - RNA, 15 nt, Artificial Sequence
  Description of Artificial Sequence: Synthetic oligonucleotide
  modified_base (15)..(15): a, c, u, g, unknown or other
gaguacguggacugn

SEQ ID NO: 2177 - RNA, 15 nt, Artificial Sequence
  Description of Artificial Sequence: Synthetic oligonucleotide
  modified_base (15)..(15): a, c, u, g, unknown or other
cgacccauaugccun

SEQ ID NO: 2178 - RNA, 15 nt, Artificial Sequence
  Description of Artificial Sequence: Synthetic oligonucleotide
  modified_base (15)..(15): a, c, u, g, unknown or other
gauacagaggacaun

SEQ ID NO: 2179 - RNA, 15 nt, Artificial Sequence
  Description of Artificial Sequence: Synthetic oligonucleotide
  modified_base (15)..(15): a, c, u, g, unknown or other
caccaaaaucaagcn

SEQ ID NO: 2180 - RNA, 15 nt, Artificial Sequence
  Description of Artificial Sequence: Synthetic oligonucleotide
  modified_base (15)..(15): a, c, u, g, unknown or other
ggaggcuccaucaun

SEQ ID NO: 2181 - RNA, 15 nt, Artificial Sequence
  Description of Artificial Sequence: Synthetic oligonucleotide
  modified_base (15)..(15): a, c, u, g, unknown or other
cagauucucaacgan

SEQ ID NO: 2182 - RNA, 15 nt, Artificial Sequence
  Description of Artificial Sequence: Synthetic oligonucleotide
  modified_base (15)..(15): a, c, u, g, unknown or other
uguaaaauggauaan

SEQ ID NO: 2183 - RNA, 15 nt, Artificial Sequence
  Description of Artificial Sequence: Synthetic oligonucleotide
  modified_base (15)..(15): a, c, u, g, unknown or other
gagugaauaggacan

SEQ ID NO: 2184 - RNA, 15 nt, Artificial Sequence
  Description of Artificial Sequence: Synthetic oligonucleotide
  modified_base (15)..(15): a, c, u, g, unknown or other
agaacuggauauugn

SEQ ID NO: 2185 - RNA, 15 nt, Artificial Sequence
  Description of Artificial Sequence: Synthetic oligonucleotide
  modified_base (15)..(15): a, c, u, g, unknown or other
aaagaaucucaaagn

SEQ ID NO: 2186 - RNA, 15 nt, Artificial Sequence
  Description of Artificial Sequence: Synthetic oligonucleotide
  modified_base (15)..(15): a, c, u, g, unknown or other
cacugccaagagugn

SEQ ID NO: 2187 - RNA, 15 nt, Artificial Sequence
  Description of Artificial Sequence: Synthetic oligonucleotide
  modified_base (15)..(15): a, c, u, g, unknown or other
gguauucuuucaagn

SEQ ID NO: 2188 - RNA, 15 nt, Artificial Sequence
  Description of Artificial Sequence: Synthetic oligonucleotide
  modified_base (15)..(15): a, c, u, g, unknown or other
guaugauauugccun

SEQ ID NO: 2189 - RNA, 15 nt, Artificial Sequence
  Description of Artificial Sequence: Synthetic oligonucleotide
  modified_base (15)..(15): a, c, u, g, unknown or other
agugaauuacacagn

SEQ ID NO: 2190 - RNA, 15 nt, Artificial Sequence
  Description of Artificial Sequence: Synthetic oligonucleotide
  modified_base (15)..(15): a, c, u, g, unknown or other
aaccaguggauauun

SEQ ID NO: 2191 - RNA, 15 nt, Artificial Sequence
  Description of Artificial Sequence: Synthetic oligonucleotide
  modified_base (15)..(15): a, c, u, g, unknown or other
uggguauucuuucan

SEQ ID NO: 2192 - RNA, 15 nt, Artificial Sequence
  Description of Artificial Sequence: Synthetic oligonucleotide
  modified_base (15)..(15): a, c, u, g, unknown or other
caguggauauuaacn

SEQ ID NO: 2193 - RNA, 15 nt, Artificial Sequence
  Description of Artificial Sequence: Synthetic oligonucleotide
  modified_base (15)..(15): a, c, u, g, unknown or other
auuuuaccaugacan

SEQ ID NO: 2194 - RNA, 15 nt, Artificial Sequence
  Description of Artificial Sequence: Synthetic oligonucleotide
  modified_base (15)..(15): a, c, u, g, unknown or other
auggcccaaagaaun

SEQ ID NO: 2195 - RNA, 15 nt, Artificial Sequence
  Description of Artificial Sequence: Synthetic oligonucleotide
  modified_base (15)..(15): a, c, u, g, unknown or other
cguuggaggaacugn

SEQ ID NO: 2196 - RNA, 15 nt, Artificial Sequence
  Description of Artificial Sequence: Synthetic oligonucleotide
  modified_base (15)..(15): a, c, u, g, unknown or other
acugaagcacacccn

SEQ ID NO: 2197 - RNA, 15 nt, Artificial Sequence
  Description of Artificial Sequence: Synthetic oligonucleotide
  modified_base (15)..(15): a, c, u, g, unknown or other
uuaaagcuuucuucn

SEQ ID NO: 2198 - RNA, 15 nt, Artificial Sequence
  Description of Artificial Sequence: Synthetic oligonucleotide
  modified_base (15)..(15): a, c, u, g, unknown or other
ggucuuuucaggaun

SEQ ID NO: 2199 - RNA, 15 nt, Artificial Sequence
  Description of Artificial Sequence: Synthetic oligonucleotide
  modified_base (15)..(15): a, c, u, g, unknown or other
acuuaaagcuuucun

SEQ ID NO: 2200 - RNA, 15 nt, Artificial Sequence
  Description of Artificial Sequence: Synthetic oligonucleotide
  modified_base (15)..(15): a, c, u, g, unknown or other
uuacagaaacacugn

SEQ ID NO: 2201 - RNA, 15 nt, Artificial Sequence
  Description of Artificial Sequence: Synthetic oligonucleotide
  modified_base (15)..(15): a, c, u, g, unknown or other
agauuuugcgugucn

SEQ ID NO: 2202 - RNA, 15 nt, Artificial Sequence
  Description of Artificial Sequence: Synthetic oligonucleotide
  modified_base (15)..(15): a, c, u, g, unknown or other
agcaaugcucacacn

SEQ ID NO: 2203 - RNA, 15 nt, Artificial Sequence
  Description of Artificial Sequence: Synthetic oligonucleotide
  modified_base (15)..(15): a, c, u, g, unknown or other
aagcucuuucuggun

SEQ ID NO: 2204 - RNA, 15 nt, Artificial Sequence
  Description of Artificial Sequence: Synthetic oligonucleotide
  modified_base (15)..(15): a, c, u, g, unknown or other
ccugugcacuuucun

SEQ ID NO: 2205 - RNA, 15 nt, Artificial Sequence
  Description of Artificial Sequence: Synthetic oligonucleotide
  modified_base (15)..(15): a, c, u, g, unknown or other
caaucugaaauaaan

SEQ ID NO: 2206 - RNA, 15 nt, Artificial Sequence
  Description of Artificial Sequence: Synthetic oligonucleotide
  modified_base (15)..(15): a, c, u, g, unknown or other
agaagaacuggauan

SEQ ID NO: 2207 - RNA, 15 nt, Artificial Sequence
  Description of Artificial Sequence: Synthetic oligonucleotide
  modified_base (15)..(15): a, c, u, g, unknown or other
cuucacuuucacggn

SEQ ID NO: 2208 - RNA, 15 nt, Artificial Sequence
  Description of Artificial Sequence: Synthetic oligonucleotide
  modified_base (15)..(15): a, c, u, g, unknown or other
uacugaagcacaccn

SEQ ID NO: 2209 - RNA, 15 nt, Artificial Sequence
  Description of Artificial Sequence: Synthetic oligonucleotide
  modified_base (15)..(15): a, c, u, g, unknown or other
gaggcccucuguccn

SEQ ID NO: 2210 - RNA, 15 nt, Artificial Sequence
  Description of Artificial Sequence: Synthetic oligonucleotide
  modified_base (15)..(15): a, c, u, g, unknown or other
aggaugauuuucuun

SEQ ID NO: 2211 - RNA, 16 nt, Artificial Sequence
  Description of Artificial Sequence: Synthetic oligonucleotide
  modified_base (16)..(16): a, c, u, g, unknown or other
cccaaagaaucucaan

SEQ ID NO: 2212 - RNA, 15 nt, Artificial Sequence
  Description of Artificial Sequence: Synthetic oligonucleotide
  modified_base (15)..(15): a, c, u, g, unknown or other
ucuccuuaaaacaun

SEQ ID NO: 2213 - RNA, 15 nt, Artificial Sequence
  Description of Artificial Sequence: Synthetic oligonucleotide
  modified_base (15)..(15): a, c, u, g, unknown or other
ugccagaaacugugn

SEQ ID NO: 2214 - RNA, 15 nt, Artificial Sequence
  Description of Artificial Sequence: Synthetic oligonucleotide
  modified_base (15)..(15): a, c, u, g, unknown or other
gaacuggauauugun

SEQ ID NO: 2215 - RNA, 15 nt, Artificial Sequence
  Description of Artificial Sequence: Synthetic oligonucleotide
  modified_base (15)..(15): a, c, u, g, unknown or other
uuucuggugaaugun

SEQ ID NO: 2216 - RNA, 15 nt, Artificial Sequence
  Description of Artificial Sequence: Synthetic oligonucleotide
  modified_base (15)..(15): a, c, u, g, unknown or other
augauauugccuugn

SEQ ID NO: 2217 - RNA, 15 nt, Artificial Sequence
  Description of Artificial Sequence: Synthetic oligonucleotide
  modified_base (15)..(15): a, c, u, g, unknown or other
caggaucguuggagn

SEQ ID NO: 2218 - RNA, 15 nt, Artificial Sequence
  Description of Artificial Sequence: Synthetic oligonucleotide
  modified_base (15)..(15): a, c, u, g, unknown or other
cuuucugguuucagn

SEQ ID NO: 2219 - RNA, 15 nt, Artificial Sequence
  Description of Artificial Sequence: Synthetic oligonucleotide
  modified_base (15)..(15): a, c, u, g, unknown or other
uugcaagggagauun

SEQ ID NO: 2220 - RNA, 15 nt, Artificial Sequence
  Description of Artificial Sequence: Synthetic oligonucleotide
  modified_base (15)..(15): a, c, u, g, unknown or other
cagugaauuacacan

SEQ ID NO: 2221 - RNA, 15 nt, Artificial Sequence
  Description of Artificial Sequence: Synthetic oligonucleotide
  modified_base (15)..(15): a, c, u, g, unknown or other
gauuuucacugaaan

SEQ ID NO: 2222 - RNA, 15 nt, Artificial Sequence
  Description of Artificial Sequence: Synthetic oligonucleotide
  modified_base (15)..(15): a, c, u, g, unknown or other
uuucaggaugauuun

SEQ ID NO: 2223 - RNA, 15 nt, Artificial Sequence
  Description of Artificial Sequence: Synthetic oligonucleotide
  modified_base (15)..(15): a, c, u, g, unknown or other
ggauaaugaguguan

SEQ ID NO: 2224 - RNA, 15 nt, Artificial Sequence
  Description of Artificial Sequence: Synthetic oligonucleotide
  modified_base (15)..(15): a, c, u, g, unknown or other
agaaacacugccaan

SEQ ID NO: 2225 - RNA, 15 nt, Artificial Sequence
  Description of Artificial Sequence: Synthetic oligonucleotide
  modified_base (15)..(15): a, c, u, g, unknown or other
auaaugaguguaccn

SEQ ID NO: 2226 - RNA, 15 nt, Artificial Sequence
  Description of Artificial Sequence: Synthetic oligonucleotide
  modified_base (15)..(15): a, c, u, g, unknown or other
ccauaugccugccun

SEQ ID NO: 2227 - RNA, 15 nt, Artificial Sequence
  Description of Artificial Sequence: Synthetic oligonucleotide
  modified_base (15)..(15): a, c, u, g, unknown or other
cuuguugaaacuggn

SEQ ID NO: 2228 - RNA, 15 nt, Artificial Sequence
  Description of Artificial Sequence: Synthetic oligonucleotide
  modified_base (15)..(15): a, c, u, g, unknown or other
aaagggagcggccan

SEQ ID NO: 2229 - RNA, 15 nt, Artificial Sequence
  Description of Artificial Sequence: Synthetic oligonucleotide
  modified_base (15)..(15): a, c, u, g, unknown or other
cuggaaaccacagun

SEQ ID NO: 2230 - RNA, 15 nt, Artificial Sequence
  Description of Artificial Sequence: Synthetic oligonucleotide
  modified_base (15)..(15): a, c, u, g, unknown or other
ggaauggcccaaagn

SEQ ID NO: 2231 - RNA, 15 nt, Artificial Sequence
  Description of Artificial Sequence: Synthetic oligonucleotide
  modified_base (15)..(15): a, c, u, g, unknown or other
ggaugauuuucuuan

SEQ ID NO: 2232 - RNA, 15 nt, Artificial Sequence
  Description of Artificial Sequence: Synthetic oligonucleotide
  modified_base (15)..(15): a, c, u, g, unknown or other
cugaaauaaaagagn

SEQ ID NO: 2233 - RNA, 15 nt, Artificial Sequence
  Description of Artificial Sequence: Synthetic oligonucleotide
  modified_base (15)..(15): a, c, u, g, unknown or other
aagaaucucaaagan

SEQ ID NO: 2234 - RNA, 15 nt, Artificial Sequence
  Description of Artificial Sequence: Synthetic oligonucleotide
  modified_base (15)..(15): a, c, u, g, unknown or other
gaggcuccaucauun

SEQ ID NO: 2235 - RNA, 15 nt, Artificial Sequence
  Description of Artificial Sequence: Synthetic oligonucleotide
  modified_base (15)..(15): a, c, u, g, unknown or other
uucugccauucuucn

SEQ ID NO: 2236 - RNA, 15 nt, Artificial Sequence
  Description of Artificial Sequence: Synthetic oligonucleotide
  modified_base (15)..(15): a, c, u, g, unknown or other
aggcuccaucauugn

SEQ ID NO: 2237 - RNA, 15 nt, Artificial Sequence
  Description of Artificial Sequence: Synthetic oligonucleotide
  modified_base (15)..(15): a, c, u, g, unknown or other
uguggaggcuccaun

SEQ ID NO: 2238 - RNA, 15 nt, Artificial Sequence
  Description of Artificial Sequence: Synthetic oligonucleotide
  modified_base (15)..(15): a, c, u, g, unknown or other
acugauuucuugggn

SEQ ID NO: 2239 - RNA, 15 nt, Artificial Sequence
  Description of Artificial Sequence: Synthetic oligonucleotide
  modified_base (15)..(15): a, c, u, g, unknown or other
cuguguggaggcucn

SEQ ID NO: 2240 - RNA, 15 nt, Artificial Sequence
  Description of Artificial Sequence: Synthetic oligonucleotide
  modified_base (15)..(15): a, c, u, g, unknown or other
ugauuucuugggagn

SEQ ID NO: 2241 - RNA, 15 nt, Artificial Sequence
  Description of Artificial Sequence: Synthetic oligonucleotide
  modified_base (15)..(15): a, c, u, g, unknown or other
caccuguguggaggn

SEQ ID NO: 2242 - RNA, 15 nt, Artificial Sequence
  Description of Artificial Sequence: Synthetic oligonucleotide
  modified_base (15)..(15): a, c, u, g, unknown or other
ggcuccaucauuggn

SEQ ID NO: 2243 - RNA, 15 nt, Artificial Sequence
  Description of Artificial Sequence: Synthetic oligonucleotide
  modified_base (15)..(15): a, c, u, g, unknown or other
uccaucauuggaaan

SEQ ID NO: 2244 - RNA, 15 nt, Artificial Sequence
  Description of Artificial Sequence: Synthetic oligonucleotide
  modified_base (15)..(15): a, c, u, g, unknown or other
cugauuucuugggan

SEQ ID NO: 2245 - RNA, 15 nt, Artificial Sequence
  Description of Artificial Sequence: Synthetic oligonucleotide
  modified_base (15)..(15): a, c, u, g, unknown or other
ccuguguggaggcun

SEQ ID NO: 2246 - RNA, 15 nt, Artificial Sequence
  Description of Artificial Sequence: Synthetic oligonucleotide
  modified_base (15)..(15): a, c, u, g, unknown or other
uucuugggagaagan

SEQ ID NO: 2247 - RNA, 15 nt, Artificial Sequence
  Description of Artificial Sequence: Synthetic oligonucleotide
  modified_base (15)..(15): a, c, u, g, unknown or other
ccaucauuggaaacn

SEQ ID NO: 2248 - RNA, 15 nt, Artificial Sequence
  Description of Artificial Sequence: Synthetic oligonucleotide
  modified_base (15)..(15): a, c, u, g, unknown or other
gcuccaucauuggan

SEQ ID NO: 2249 - RNA, 15 nt, Artificial Sequence
  Description of Artificial Sequence: Synthetic oligonucleotide
  modified_base (15)..(15): a, c, u, g, unknown or other
guguggaggcuccan

SEQ ID NO: 2250 - RNA, 15 nt, Artificial Sequence
  Description of Artificial Sequence: Synthetic oligonucleotide
  modified_base (15)..(15): a, c, u, g, unknown or other
accuguguggaggcn

SEQ ID NO: 2251 - RNA, 34 nt, Artificial Sequence
  Description of Artificial Sequence: Synthetic oligonucleotide
uuggugugagcauugcuugcaaugcucacaccaa

SEQ ID NO: 2252 - RNA, 34 nt, Artificial Sequence
  Description of Artificial Sequence: Synthetic oligonucleotide
uuauaagaaaaucauccugaugauuuucuuauaa

SEQ ID NO: 2253 - RNA, 34 nt, Artificial Sequence
  Description of Artificial Sequence: Synthetic oligonucleotide
ugguuuccaaugauggagccaucauuggaaacca

SEQ ID NO: 2254 - RNA, 19 nt, Artificial Sequence
  Description of Artificial Sequence: Synthetic oligonucleotide
uuuucagugaaaauccaga

SEQ ID NO: 2255 - RNA, 19 nt, Artificial Sequence
  Description of Artificial Sequence: Synthetic oligonucleotide
uaaaucauccugaaaagac

SEQ ID NO: 2256 - RNA, 19 nt, Artificial Sequence
  Description of Artificial Sequence: Synthetic oligonucleotide
uuacacucauuauccauuu

SEQ ID NO: 2257 - RNA, 19 nt, Artificial Sequence
  Description of Artificial Sequence: Synthetic oligonucleotide
uuuggcaguguuucuguaa

SEQ ID NO: 2258 - RNA, 19 nt, Artificial Sequence
  Description of Artificial Sequence: Synthetic oligonucleotide
ugguacacucauuauccau

SEQ ID NO: 2259 - RNA, 19 nt, Artificial Sequence
  Description of Artificial Sequence: Synthetic oligonucleotide
uaggcaggcauaugggucg

SEQ ID NO: 2260 - RNA, 19 nt, Artificial Sequence
  Description of Artificial Sequence: Synthetic oligonucleotide
uccaguuucaacaaggcaa

SEQ ID NO: 2261 - RNA, 19 nt, Artificial Sequence
  Description of Artificial Sequence: Synthetic oligonucleotide
uuggccgcucccuuugagc

SEQ ID NO: 2262 - RNA, 19 nt, Artificial Sequence
  Description of Artificial Sequence: Synthetic oligonucleotide
uacugugguuuccaguuuc

SEQ ID NO: 2263 - RNA, 19 nt, Artificial Sequence
  Description of Artificial Sequence: Synthetic oligonucleotide
ucuuugggccauuccuggg

SEQ ID NO: 2264 - RNA, 19 nt, Artificial Sequence
  Description of Artificial Sequence: Synthetic oligonucleotide
uuaagaaaaucauccugaa

SEQ ID NO: 2265 - RNA, 19 nt, Artificial Sequence
  Description of Artificial Sequence: Synthetic oligonucleotide
ucucuuuuauuucagauug

SEQ ID NO: 2266 - RNA, 19 nt, Artificial Sequence
  Description of Artificial Sequence: Synthetic oligonucleotide
uucuuugagauucuuuggg

SEQ ID NO: 2267 - RNA, 19 nt, Artificial Sequence
  Description of Artificial Sequence: Synthetic oligonucleotide
uaaugauggagccuccaca

SEQ ID NO: 2268 - RNA, 19 nt, Artificial Sequence
  Description of Artificial Sequence: Synthetic oligonucleotide
ugaagaauggcagaacacu

SEQ ID NO: 2269 - RNA, 19 nt, Artificial Sequence
  Description of Artificial Sequence: Synthetic oligonucleotide
ucaaugauggagccuccac

SEQ ID NO: 2270 - RNA, 19 nt, Artificial Sequence
  Description of Artificial Sequence: Synthetic oligonucleotide
uauggagccuccacacagg

SEQ ID NO: 2271 - RNA, 19 nt, Artificial Sequence
  Description of Artificial Sequence: Synthetic oligonucleotide
ucccaagaaaucaguguca

SEQ ID NO: 2272 - RNA, 19 nt, Artificial Sequence
  Description of Artificial Sequence: Synthetic oligonucleotide
ugagccuccacacaggugu

SEQ ID NO: 2273 - RNA, 19 nt, Artificial Sequence
  Description of Artificial Sequence: Synthetic oligonucleotide
ucucccaagaaaucagugu

SEQ ID NO: 2274 - RNA, 19 nt, Artificial Sequence
  Description of Artificial Sequence: Synthetic oligonucleotide
uccuccacacaggugucuc

SEQ ID NO: 2275 - RNA, 19 nt, Artificial Sequence
  Description of Artificial Sequence: Synthetic oligonucleotide
uccaaugauggagccucca

SEQ ID NO: 2276 - RNA, 19 nt, Artificial Sequence
  Description of Artificial Sequence: Synthetic oligonucleotide
uuuuccaaugauggagccu

SEQ ID NO: 2277 - RNA, 19 nt, Artificial Sequence
  Description of Artificial Sequence: Synthetic oligonucleotide
uucccaagaaaucaguguc

SEQ ID NO: 2278 - RNA, 19 nt, Artificial Sequence
  Description of Artificial Sequence: Synthetic oligonucleotide
uagccuccacacagguguc

SEQ ID NO: 2279 - RNA, 19 nt, Artificial Sequence
  Description of Artificial Sequence: Synthetic oligonucleotide
uucuucucccaagaaauca

SEQ ID NO: 2280 - RNA, 19 nt, Artificial Sequence
  Description of Artificial Sequence: Synthetic oligonucleotide
uguuuccaaugauggagcc

SEQ ID NO: 2281 - RNA, 19 nt, Artificial Sequence
  Description of Artificial Sequence: Synthetic oligonucleotide
uuccaaugauggagccucc

SEQ ID NO: 2282 - RNA, 19 nt, Artificial Sequence
  Description of Artificial Sequence: Synthetic oligonucleotide
uuggagccuccacacaggu

SEQ ID NO: 2283 - RNA, 19 nt, Artificial Sequence
  Description of Artificial Sequence: Synthetic oligonucleotide
ugccuccacacaggugucu

SEQ ID NO: 2284 - RNA, 35 nt, Artificial Sequence
  Description of Artificial Sequence: Synthetic oligonucleotide
  modified_base (1)..(1): a, c, u, g, unknown or other
  modified_base (35)..(35): a, c, u, g, unknown or other
nuuggugugagcauugcuugcaaugcucacaccan

SEQ ID NO: 2285 - RNA, 34 nt, Artificial Sequence
  Description of Artificial Sequence: Synthetic oligonucleotide
  modified_base (1)..(1): a, c, u, g, unknown or other
  modified_base (34)..(34): a, c, u, g, unknown or other
nuauaagaaaaucauccugaugauuuucuuauan

SEQ ID NO: 2286 - RNA, 34 nt, Artificial Sequence
  Description of Artificial Sequence: Synthetic oligonucleotide
  modified_base (1)..(1): a, c, u, g, unknown or other
  modified_base (34)..(34): a, c, u, g, unknown or other
ngguuuccaaugauggagccaucauuggaaaccn

SEQ ID NO: 2287 - RNA, 31 nt, Artificial Sequence
  Description of Artificial Sequence: Synthetic oligonucleotide
uuauaagaaaaucauccugauuuucuuauaa

SEQ ID NO: 2288 - RNA, 34 nt, Artificial Sequence; identical to SEQ ID NO: 2252
  Description of Artificial Sequence: Synthetic oligonucleotide

SEQ ID NO: 2289 - RNA, 34 nt, Artificial Sequence; identical to SEQ ID NO: 2252
  Description of Artificial Sequence: Synthetic oligonucleotide

SEQ ID NO: 2290 - RNA, 31 nt, Artificial Sequence; identical to SEQ ID NO: 2287
  Description of Artificial Sequence: Synthetic oligonucleotide

SEQ ID NO: 2291 - RNA, 34 nt, Artificial Sequence; identical to SEQ ID NO: 2252
  Description of Artificial Sequence: Synthetic oligonucleotide

SEQ ID NO: 2292 - RNA, 34 nt, Artificial Sequence; identical to SEQ ID NO: 2252
  Description of Artificial Sequence: Synthetic oligonucleotide

SEQ ID NO: 2293 - RNA, 19 nt, Artificial Sequence
  Description of Artificial Sequence: Synthetic oligonucleotide
gugccagaagagauacaga

SEQ ID NO: 2294 - RNA, 15 nt, Artificial Sequence
  Description of Artificial Sequence: Synthetic oligonucleotide
  modified_base (15)..(15): a, c, u, g, unknown or other
aaagccaagauaccn

SEQ ID NO: 2295 - RNA, 19 nt, Artificial Sequence
  Description of Artificial Sequence: Synthetic oligonucleotide
uaagaaagcuuuaaguaac

SEQ ID NO: 2296 - RNA, 34 nt, Artificial Sequence; identical to SEQ ID NO: 2251
  Description of Artificial Sequence: Synthetic oligonucleotide

SEQ ID NO: 2297 - RNA, 34 nt, Artificial Sequence; identical to SEQ ID NO: 2252
  Description of Artificial Sequence: Synthetic oligonucleotide

SEQ ID NO: 2298 - RNA, 34 nt, Artificial Sequence; identical to SEQ ID NO: 2253
  Description of Artificial Sequence: Synthetic oligonucleotide

SEQ ID NO: 2299 - RNA, 34 nt, Artificial Sequence; identical to SEQ ID NO: 2251
  Description of Artificial Sequence: Synthetic oligonucleotide

SEQ ID NO: 2300 - RNA, 34 nt, Artificial Sequence; identical to SEQ ID NO: 2252
  Description of Artificial Sequence: Synthetic oligonucleotide

SEQ ID NO: 2301 - RNA, 34 nt, Artificial Sequence; identical to SEQ ID NO: 2253
  Description of Artificial Sequence: Synthetic oligonucleotide

SEQ ID NO: 2302 - RNA, 34 nt, Artificial Sequence; identical to SEQ ID NO: 2251
  Description of Artificial Sequence: Synthetic oligonucleotide

SEQ ID NO: 2303 - RNA, 34 nt, Artificial Sequence; identical to SEQ ID NO: 2252
  Description of Artificial Sequence: Synthetic oligonucleotide

SEQ ID NO: 2304 - RNA, 34 nt, Artificial Sequence; identical to SEQ ID NO: 2253
  Description of Artificial Sequence: Synthetic oligonucleotide

SEQ ID NO: 2305 - RNA, 34 nt, Artificial Sequence; identical to SEQ ID NO: 2251
  Description of Artificial Sequence: Synthetic oligonucleotide

SEQ ID NO: 2306 - RNA, 34 nt, Artificial Sequence; identical to SEQ ID NO: 2252
  Description of Artificial Sequence: Synthetic oligonucleotide

SEQ ID NO: 2307 - RNA, 34 nt, Artificial Sequence; identical to SEQ ID NO: 2253
  Description of Artificial Sequence: Synthetic oligonucleotide

SEQ ID NO: 2308 - RNA, 34 nt, Artificial Sequence; identical to SEQ ID NO: 2251
  Description of Artificial Sequence: Synthetic oligonucleotide

SEQ ID NO: 2309 - RNA, 34 nt, Artificial Sequence; identical to SEQ ID NO: 2252
  Description of Artificial Sequence: Synthetic oligonucleotide

SEQ ID NO: 2310 - RNA, 34 nt, Artificial Sequence; identical to SEQ ID NO: 2253
  Description of Artificial Sequence: Synthetic oligonucleotide

SEQ ID NO: 2311 - RNA, 34 nt, Artificial Sequence; identical to SEQ ID NO: 2251
  Description of Artificial Sequence: Synthetic oligonucleotide

SEQ ID NO: 2312 - RNA, 34 nt, Artificial Sequence; identical to SEQ ID NO: 2252
  Description of Artificial Sequence: Synthetic oligonucleotide

SEQ ID NO: 2313 - RNA, 34 nt, Artificial Sequence; identical to SEQ ID NO: 2253
  Description of Artificial Sequence: Synthetic oligonucleotide

SEQ ID NO: 2314 - RNA, 34 nt, Artificial Sequence; identical to SEQ ID NO: 2251
  Description of Artificial Sequence: Synthetic oligonucleotide

SEQ ID NO: 2315 - RNA, 34 nt, Artificial Sequence; identical to SEQ ID NO: 2252
  Description of Artificial Sequence: Synthetic oligonucleotide

SEQ ID NO: 2316 - RNA, 34 nt, Artificial Sequence; identical to SEQ ID NO: 2253
  Description of Artificial Sequence: Synthetic oligonucleotide

SEQ ID NO: 2317 - RNA, 35 nt, Artificial Sequence
  Description of Artificial Sequence: Synthetic oligonucleotide
  modified_base (34)..(35): a, c, u, g, unknown or other
uuggugugagcauugcuugcaaugcucacaccann

SEQ ID NO: 2318 - RNA, 35 nt, Artificial Sequence
  Description of Artificial Sequence: Synthetic oligonucleotide
  modified_base (34)..(35): a, c, u, g, unknown or other
uuauaagaaaaucauccugaugauuuucuuauann

SEQ ID NO: 2319 - RNA, 35 nt, Artificial Sequence
  Description of Artificial Sequence: Synthetic oligonucleotide
  modified_base (34)..(35): a, c, u, g, unknown or other
ugguuuccaaugauggagccaucauuggaaaccnn

SEQ ID NO: 2320 - RNA, 34 nt, Artificial Sequence; identical to SEQ ID NO: 2251
  Description of Artificial Sequence: Synthetic oligonucleotide

SEQ ID NO: 2321 - RNA, 34 nt, Artificial Sequence; identical to SEQ ID NO: 2252
  Description of Artificial Sequence: Synthetic oligonucleotide

SEQ ID NO: 2322 - RNA, 34 nt, Artificial Sequence; identical to SEQ ID NO: 2253
  Description of Artificial Sequence: Synthetic oligonucleotide

SEQ ID NO: 2323 - RNA, 34 nt, Artificial Sequence; identical to SEQ ID NO: 2251
  Description of Artificial Sequence: Synthetic oligonucleotide

SEQ ID NO: 2324 - RNA, 34 nt, Artificial Sequence; identical to SEQ ID NO: 2252
  Description of Artificial Sequence: Synthetic oligonucleotide

SEQ ID NO: 2325 - RNA, 34 nt, Artificial Sequence; identical to SEQ ID NO: 2253
  Description of Artificial Sequence: Synthetic oligonucleotide

SEQ ID NO: 2326 - RNA, 34 nt, Artificial Sequence; identical to SEQ ID NO: 2251
  Description of Artificial Sequence: Synthetic oligonucleotide

SEQ ID NO: 2327 - RNA, 34 nt, Artificial Sequence; identical to SEQ ID NO: 2252
  Description of Artificial Sequence: Synthetic oligonucleotide

SEQ ID NO: 2328 - RNA, 34 nt, Artificial Sequence; identical to SEQ ID NO: 2253
  Description of Artificial Sequence: Synthetic oligonucleotide

SEQ ID NO: 2329 - RNA, 34 nt, Artificial Sequence; identical to SEQ ID NO: 2252
  Description of Artificial Sequence: Synthetic oligonucleotide

SEQ ID NO: 2330 - RNA, 34 nt, Artificial Sequence; identical to SEQ ID NO: 2251
  Description of Artificial Sequence: Synthetic oligonucleotide

SEQ ID NO: 2331 - RNA, 34 nt, Artificial Sequence; identical to SEQ ID NO: 2253
  Description of Artificial Sequence: Synthetic oligonucleotide

SEQ ID NO: 2332 - RNA, 34 nt, Artificial Sequence; identical to SEQ ID NO: 2252
  Description of Artificial Sequence: Synthetic oligonucleotide

SEQ ID NO: 2333 - RNA, 34 nt, Artificial Sequence
  Description of Artificial Sequence: Synthetic oligonucleotide
uuauaagaaaaucauccuaaugauuuucuuauaa

SEQ ID NO: 2334 - RNA, 34 nt, Artificial Sequence; identical to SEQ ID NO: 2252
  Description of Artificial Sequence: Synthetic oligonucleotide

SEQ ID NO: 2335 - RNA, 34 nt, Artificial Sequence; identical to SEQ ID NO: 2252
  Description of Artificial Sequence: Synthetic oligonucleotide

SEQ ID NO: 2336 - RNA, 34 nt, Artificial Sequence; identical to SEQ ID NO: 2252
  Description of Artificial Sequence: Synthetic oligonucleotide

SEQ ID NO: 2337 - RNA, 35 nt, Artificial Sequence; identical to SEQ ID NO: 2318
  Description of Artificial Sequence: Synthetic oligonucleotide
  modified_base (34)..(35): a, c, u, g, unknown or other

SEQ ID NO: 2338 - RNA, 34 nt, Artificial Sequence; identical to SEQ ID NO: 2252
  Description of Artificial Sequence: Synthetic oligonucleotide

SEQ ID NO: 2339 - RNA, 34 nt, Artificial Sequence; identical to SEQ ID NO: 2252
  Description of Artificial Sequence: Synthetic oligonucleotide

SEQ ID NO: 2340 - RNA, 34 nt, Artificial Sequence
  Description of Artificial Sequence: Synthetic oligonucleotide
auauaagaaaaucauccugaugauuuucuuauaa

SEQ ID NO: 2341 - RNA, 35 nt, Artificial Sequence
  Description of Artificial Sequence: Synthetic oligonucleotide
  modified_base (35)..(35): a, c, u, g, unknown or other
uuauaagaaaaucauccugaugauuuucuuauaan

SEQ ID NO: 2342 - RNA, 35 nt, Artificial Sequence; identical to SEQ ID NO: 2341
  Description of Artificial Sequence: Synthetic oligonucleotide
  modified_base (35)..(35): a, c, u, g, unknown or other

SEQ ID NO: 2343 - RNA, 34 nt, Artificial Sequence; identical to SEQ ID NO: 2252
  Description of Artificial Sequence: Synthetic oligonucleotide

SEQ ID NO: 2344 - RNA, 19 nt, Artificial Sequence
  Description of Artificial Sequence: Synthetic oligonucleotide
uuauaagaaaaucauccug

SEQ ID NO: 2345 - RNA, 15 nt, Artificial Sequence
  Description of Artificial Sequence: Synthetic oligonucleotide
augauuuucuuauaa

SEQ ID NO: 2346 - RNA, 34 nt, Artificial Sequence
  Description of Artificial Sequence: Synthetic oligonucleotide
  modified_base (19)..(19): a, c, u, g, unknown or other
uuauaagaaaaucauccunaugauuuucuuauaa

SEQ ID NO: 2347 - RNA, 34 nt, Artificial Sequence
  Description of Artificial Sequence: Synthetic oligonucleotide
  modified_base (33)..(33): a, c, u, g, unknown or other
uuauaagaaaaucauccugaugauuuucuuauna

SEQ ID NO: 2348 - RNA, 31 nt, Artificial Sequence; identical to SEQ ID NO: 2287
  Description of Artificial Sequence: Synthetic oligonucleotide

SEQ ID NO: 2349 - RNA, 33 nt, Artificial Sequence
  Description of Artificial Sequence: Synthetic oligonucleotide
uuauaagaaaaucauccugugauuuucuuauaa

SEQ ID NO: 2350 - RNA, 34 nt, Artificial Sequence; identical to SEQ ID NO: 2346
  Description of Artificial Sequence: Synthetic oligonucleotide
  modified_base (19)..(19): a, c, u, g, unknown or other

SEQ ID NO: 2351 - RNA, 34 nt, Artificial Sequence; identical to SEQ ID NO: 2252
  Description of Artificial Sequence: Synthetic oligonucleotide

SEQ ID NO: 2352 - RNA, 34 nt, Artificial Sequence; identical to SEQ ID NO: 2252
  Description of Artificial Sequence: Synthetic oligonucleotide

SEQ ID NO: 2353 - RNA, 34 nt, Artificial Sequence; identical to SEQ ID NO: 2347
  Description of Artificial Sequence: Synthetic oligonucleotide
  modified_base (33)..(33): a, c, u, g, unknown or other

SEQ ID NO: 2354 - RNA, 34 nt, Artificial Sequence; identical to SEQ ID NO: 2252
  Description of Artificial Sequence: Synthetic oligonucleotide

SEQ ID NO: 2355 - RNA, 31 nt, Artificial Sequence; identical to SEQ ID NO: 2287
  Description of Artificial Sequence: Synthetic oligonucleotide

SEQ ID NO: 2356 - RNA, 33 nt, Artificial Sequence; identical to SEQ ID NO: 2349
  Description of Artificial Sequence: Synthetic oligonucleotide

SEQ ID NO: 2357 - RNA, 34 nt, Artificial Sequence; identical to SEQ ID NO: 2252
  Description of Artificial Sequence: Synthetic oligonucleotide

SEQ ID NO: 2358 - RNA, 34 nt, Artificial Sequence; identical to SEQ ID NO: 2252
  Description of Artificial Sequence: Synthetic oligonucleotide

SEQ ID NO: 2359 - RNA, 34 nt, Artificial Sequence; identical to SEQ ID NO: 2252
  Description of Artificial Sequence: Synthetic oligonucleotide

SEQ ID NO: 2360 - RNA, 34 nt, Artificial Sequence; identical to SEQ ID NO: 2252
  Description of Artificial Sequence: Synthetic oligonucleotide

SEQ ID NO: 2361 - RNA, 34 nt, Artificial Sequence; identical to SEQ ID NO: 2252
  Description of Artificial Sequence: Synthetic oligonucleotide

SEQ ID NO: 2362 - RNA, 34 nt, Artificial Sequence; identical to SEQ ID NO: 2252
  Description of Artificial Sequence: Synthetic oligonucleotide

SEQ ID NO: 2363 - RNA, 34 nt, Artificial Sequence; identical to SEQ ID NO: 2252
  Description of Artificial Sequence: Synthetic oligonucleotide

SEQ ID NO: 2364 - RNA, 34 nt, Artificial Sequence; identical to SEQ ID NO: 2252
  Description of Artificial Sequence: Synthetic oligonucleotide

SEQ ID NO: 2365 - RNA, 31 nt, Artificial Sequence; identical to SEQ ID NO: 2287
  Description of Artificial Sequence: Synthetic oligonucleotide

SEQ ID NO: 2366 - RNA, 31 nt, Artificial Sequence; identical to SEQ ID NO: 2287
  Description of Artificial Sequence: Synthetic oligonucleotide

The invention claimed is:

1. An oligomeric compound that inhibits expression of Factor XI ("FXI"), comprising a single oligonucleotide strand, wherein said single strand consists of a modified or unmodified oligonucleotide selected from the group consisting of SEQ ID NOs: 2252, 2287, 2288, 2290-2292, 2297, 2300, 2303, 2306, 2309, 2312, 2315, 2321, 2324, 2327, 2332, 2334-2336, 2338, 2339, 2343, 2348, 2351, 2352, 2354, 2355, and 2357-2366.

2. An oligomeric compound according to claim 1, further comprising one or more ligands.

3. An oligomeric compound according to claim 2, wherein said one or more ligands are conjugated to the 3' end of said oligonucleotide.

4. An oligomeric compound according to claim 3, wherein said one or more ligands comprise one or more N-Acetyl-Galactosamine moieties.

5. An oligomeric compound according to claim 1, wherein a terminal end nucleoside of the oligomeric compound is an inverted nucleoside and is attached to an adjacent nucleoside via the 3' carbon of its sugar and the 3' carbon of the sugar of the adjacent nucleoside or is attached to an adjacent nucleoside via the 5' carbon of its sugar and the 5' carbon of the sugar of the adjacent nucleoside.

6. A composition comprising an oligomeric compound according to claim 1, and a physiologically acceptable excipient.

7. A method of treating a disease or disorder selected from the group consisting of deep vein thrombosis, venous or arterial thrombosis, pulmonary embolism, myocardial infarction, stroke, thrombosis associated with chronic kidney disease and end-stage renal disease (ESRD) comprising administering an oligomeric compound according to claim 1 to an individual in need of treatment for said disease or disorder.

8. An oligomeric compound according to claim 1, wherein said single strand consists of an oligonucleotide selected from the group consisting of SEQ ID NOs: 2252, 2288, 2291-2292, 2297, 2300, 2303, 2306, 2309, 2312, 2315, 2321, 2324, 2327, 2332, 2334-2336, 2338, 2339, 2343, 2352, 2354, and 2357-2364.

9. An oligomeric compound according to claim 1, wherein said single strand consists of an oligonucleotide selected from the group consisting of SEQ ID NOs: 2287, 2290, 2348, 2351, 2355, and 2365.

10. An oligomeric compound according to claim 9, wherein said single strand consists of SEQ ID NO: 2287.

11. An oligomeric compound according to claim 8, wherein said single strand consists of SEQ ID NO: 2288.

12. An oligomeric compound according to claim 9, wherein said single strand consists of SEQ ID NO: 2290.

13. An oligomeric compound according to claim 9, wherein said single strand consists of SEQ ID NO: 2348.

14. An oligomeric compound according to claim 8, wherein said single strand consists of SEQ ID NO: 2291.

15. An oligomeric compound according to claim 8, wherein said single strand consists of SEQ ID NO: 2292.

16. An oligomeric compound according to claim 8, wherein said single strand consists of SEQ ID NO: 2297.

17. An oligomeric compound according to claim 8, wherein said single strand consists of SEQ ID NO: 2300.

18. An oligomeric compound according to claim 8, wherein said single strand consists of SEQ ID NO: 2332.

19. An oligomeric compound according to claim 8, wherein said single strand consists of SEQ ID NO: 2352.

20. An oligomeric compound according to claim 8, wherein said single strand consists of SEQ ID NO: 2354.

* * * * *